United States Patent 11,549,145 (METHODS AND COMPOSITIONS FOR INHIBITING AND TREATING NEUROLOGICAL CONDITIONS) - sequence listing, part 10

SEQ ID NO: 27 - DNA, 18527786 bp, Homo sapiens (residues 12,351,859-14,410,501 of 18,527,786)
  misc_feature (4041202)..(4061201): n is a, c, g, or t
atgggagaaaaataaaacgatgtgtttctgctttcgattggagagctccccagagccgtctttggaattgctgttccctgaggggatatggtagccagagcatgttggcccagctgatgttttctaggattggtctttgagtgtggcatttgctgtctctgtgtcccgagggccagtggcctgcactgggcagcctgtaacatcagatggcattgtgagatcaaagccccaggagacattccagcatgaagctggcctttcagatagagcctgtaattccatcccatggtgtcaggtcctaggacaagaacacctgcacagcactccacggtgcacggaggcccttctcaacagccccaagaaggaactgcggctcctccccacagaggacaggcgggcagcaggggagaagagggatagacacaaactccctctccttcagaggcccgagagtgaaatccagcgagtgtgcatggagcgcctgctctttaccaggtgctggatgagaatcagggaatgcagcggccagaacctgttggctcagctgccaggattaggtttcagctggacatgggaaaaatccagaccaaattcctgttcccgtggagctgacagtctaactgaggaagagccgaggactcggaggctccgggagccagtgtggcctgctcggggtttgtcattttccagagcagcgggtttcaggtggggctgaggcccttctgagccgtggctgtaaaccggcctcactcacctcagagggcagctgtggccactgagtgcgtgatgtgtatgaaaacacaggcacctgggccatggtacctttccttatcgtaggaattgtcagcatcatttttatcctctgttattactgttattatcataagccattttcctgtcctgaagcattgagcggtttccccagaggcagagcgcaggagtgaacctccgtgacctgtagaaggagccacctctggaacttccgggaattcttttagccaaggaggagccagagcgtgactagggcagcgcgcaaggctgctaggaagataggcagggtgcgccatctgctgtagccggggggaattgccgtggacagtgtcctggccctcctctattttacacaggggaaatgaaggccccaagaaaggcagggtcttgcccagggttaggtggcagagcttgggtttaaggtcacgtgtctcattctttgctctttctaccataggacacctccctgtctcacctgtctgatctttgagggcccctaattcattctttaggtgtttcttctgagctaggtgttgtggggggatgtgggccttgccctccatactgatcctcttctctgtctctctctttctctctctctctctctctctcttctctctctctctctcacacacacacacacacacacacacacacctgcagcacttactggctcaaccccaccctgggtgccttctgggcacttctgccaatgtcagctaccttctaaaagcattgcacaataatttgggtttataaaacttcaaccattgaaaaaatatagacttagaaaacgaaagttccccttaatcacaaagaaccacagttgacagggttgatagatgttttttcagatttttttttcatatgtctgctatctttccccacaggaactgggttttattttaggtgttgttttgcaacctctgtttttcagttgccagtttatctcagacattgtcctatgtcagtacaggcccatctggcacatttctttattattttttttttactgacatgtcattgtatatatttgtggggtgcaacttgatgttttgatacatatatgttgtataataatcagatcagggcagttagcatatccatcatctcatgcatttatttctttgtgatgagaatattcaaaagcttctgtagttattttgtaatatagaatgccttttttttttttttttttgagacggagtctcgctctgtcttgcccagggtggagtgcagtggcgtgatctcagctcacggcagtctccgcctcatgggttcaagagattctcctgtctcagcctccagagtaactgagactacaggcgtgtgctaccacacccgactaattttgtatttttagtagaggcgacgtttcacgatgttggccagcccagtctcgaacttctgacctcaggtgaactacccgcctcggcctcccaaagtgctgggattataggcatgagccaccgcacccggcctagaatgccttattgttaaccatcaccatactgtacaatagaacaggaacttactgctcctatctaattgtaactatgtacccgttgaccagctttccatcctttcctctcctctcccctccccagtctctggtaaccactgttgtattctctccttctatatcaacttttttttttttttttgacagagttttgctctgtcacctaggctagagtgcagtgtcatgatcttggctcactgcaagctccgcctcctgggttcacgccattctcctgcctcagcctcctgagtagctgggactacaggcgcctgccaccacgcctggctaatttttgtttgtttttttagtagagagggggtttcaccatgttggccaggatggtctcgatctcctgacctagtgatccacccgcctcggcctcccaaagtactgggattacaggtgtgagccactgtgcctagccgataacaaatttttttttttttaagattccatgtatgcgtaaaatcatgcagtatttgtgtttctgtgtctggcttatttcacttaacattatgtcctccaggtttatccgttttgtcccaaataacaagatttcattcttttttatggctgaatagtattcctttgtgtatatatacattttctgtatccattcaatcatgttggacatttgggttgattccatatcttggctattataaatagtgctgcagtaaacataggaggtcagatgtcttcttgacataccaatgtcagttctttggatatatacctagtagtgggattgttgggtcatatggtactgtttttaattttctcaggaaccctccatactgttttccatagtggctgtatggcacatttcttttttatgactacttcataattcacgcgatgcctaacctcctggtggacatttgggtggtttcctataggctgctattactgaccaggtgcagtaaacatcctcacactagagaaaacattgggcatttgcctgagtgggtctagaactaggatttgctgggtgggcccatgggcccaccccactggactatgaactcctaaagtcaggccagtgcttagaccacccctcccacttactaattcaggtctgcgaggtagccagagtccatgcaatgactgctatctaattgccttcagaaaaccataggtgctcaatgagagatactagtatccccttcgcaaattaaccttttgttaatatagtagcagtacttcttgttgccaagagtacataaatggacaatcttgtgtgctactggtgggaatataaataaaaacagcactgactttataagtctttctgccaattttttgtcatcatgaataccactgtgctatttgggaaggcaactgggaaatgtgtcaaaaatctaaaaattatttcacccttccctttagcccagcagttctacttctagggatatactctcaggaaacaattagggatgggcacagagactttcataaagtcccagtgctgtgtgtggcggtagaaaacagggaagtacctctgtgttcatttctggaggcctcatcctagagtaaatcatggcccatccaagcatgctggcacaaaattcatgtggagggagacttagtgacatgttctaaagcgtcccaaagagtaggctacaaaacacaacataaggtatggtcccaaatcatttctaaatgtatgtggctcttctttatatatgtggcactcttctctcctttctctagactgtgttaccaagcaccagggctgttaactgctgtctctgtagtaagaactactaatttattttttctttttttcgagatggagtctcgctttgtcgcccaggctggagtgcagtggcacaatctcggctcactgcaagttctgcctcccgggttcatgccattctcctgcctcagcctcctgagtagctggaactacaggcgcccgccaccacgcccggctaatttttttgtatttttagtagagatgggatttcactgtgttagccaggatggtcttgatctagaactactaatttcatatctttcctccccactccacctctcttctgagctccagcctcctagttccatgtacctagcctacctctccccttggagggctcacaggcatctcaaagttaccgaataggccaaacaggactttatgccctcaaatattcctcctttgttcttccatatgtcagcaaaccacacttctgtccacctacttattcacaccagaaacctaaattacctgtcaatccaacactacttcttgttggttcgatttccaagttatatctagaatccttcccactgcccccctcctccacccaccatcttggcacctgaacttcacaggagcctcctaacttgccccttcccagcactgctgtgcccggccgccacagtcacctttgaaaatgcacggctgctacttcatggccttgcctaaagcccctcaggaaccaagttccagatgtggtctggctcctgcctacctcagcagtgtccttggtgtcattgtccctcttctgccatgctcccgcctgctggctctttctgtccttccaagccctcatgcctccctccctcagagccttcacacatgctgttcccctctctgtagtgctcttcccctcactcttcatctgcatgacgcctcgtcctccttggttctcagctaaaatgtcactttgtgacccccagccttgatcaggtcccagtgatcactccagcaccctgcattctcccttgaagccttgagcaccaaggccatgacttaggtacgaggtgactttatgccacctgtagtagatggtaagctctgtgaggccagggaccatggccagtttgttcatggtggtatctgtgccagtgcctggcgcatggtattaataaatgtgtgtacatgtttgtcaataattttatttaaagaaaagtctgagcccatgttctttaaaatgttgatggtggttgtctgggtgtggaattatgagtgacttgttttgttctttgtacttttctgtgctttttgctttgttttcaataagaggcaataactgtcattttgacagaagccactgtgctggggaactggagctgtcctctctgcagaatgcatctggacttacctctgcccccttgccttctgtccccacaggcctgaggagcgatgcgacaggcatgatggaggtcgagtcctcctactcggacttcatctcctgtgaccggacaggccgtcggaatgcggtccctgacatccagggagactcagaggctgtgagcgtgaggaagctggctggagacatgggcgagctggcactcgagggggcaggttagagccagcaggtccttggcactactgcatgccagaggccctctgccgggccccgggctagcctccaagtcctagactgcccatactttcttagagaagaaaccacatttaagtcaggcctgccccatggtcagtggcagagtccagcaatctctaggttggaagatgtttgagtctcaggccccaaggactcctctggacaggcatccgggactcttcctgtccccctgccccctagcccaggtccctccacttctcgctatccccacagctatacctggctctggccactcacagctctcacctggctgactttagcggccggcttccctgggctccctacacccatctccgcccttcctgttcagctctatgcagcagccagcagaccccatttaaaccattctgtccatcatgcttctgccaaaaaaaaaaaatcccccagtggcttcactgagtgaagctaagcttgtcacattgccctggggcagtcctgctgtaggccgggccctgcccaagtctcacccggtgccactcctctccctgacaccctccagctacatctacctttggtctgtttctcagtcaagcctctccaaggggccttctctgagtgctagatcagccttccccaatcacatgaccctcatcactctctgacaaggtctcaggggtctaaatgtgagcgccgggagggcagaggccttgcattctgtttggcacacagcaggtgcttggtaaccacagaccgaatgacaaaaggaaacagcatccacccacccaagtcctggctggaacacccccaccccctccattcccccagagaaccccttggctcaagtccacagtcagcctgggaatttccttgggaagcttccctgacccctgcacggctgaggcctttccctcctgctctcacagcgccacagaggccgtgtgtgcttctcacagcacagccatcaggctgcaactgtctccccgtgggctgtccggagggccacagccctgcccctccctgggtagccctagtcttcttgcccctcactggccagaagtgaatcaaaagtacagaacagagaagactttgccggggcttggacccagccctctcatgttacagatggacaaactgaggcccagagaagttggaggacttgctctgggccacccagggagttaacatagaatctggccggcttgagagagagcccccagcaccctgtcgacggaaccccaccccaaaagccttccctgtcccataatctattcattctcctctgtcacgtggcccaggcagaacctccacaggctcaccctgctcgcctctccagcatcaactctcatcctctcgccagccatagtcaagtactttgatcgctcagaagcccctgtgggccttcacacgctgcacctctgtttgcttctcccctccctccccttgcctggctgggttctcttcattcttagagacccaggcatctgctcagctgagaagccttccctgaccgcagtacccctcccagaccggggaggcacctcttctccctgctgcctccatgagcccactgagcataatggccctgctctagactgagcttctccagcacaggctctgtgtcttgtgccctcggtgcctggtggtgtttggcacatgatggaggtaccgagtcaatggctgttcattgaccgactgaatgaccagcatgtccagctgccacactgggcacgctgccctgggctctctctcaaggcttctgtgtcctcaccctcagctctggtgagctctgttctgtctctctctccctcagcagttgtagctgctggcccatgtgcccaggctctcctaacacctgttttccctgactcagattccctaaagtatgggtcctctggctacatgacattcacctgccagggtgactgacatttaaaaagggggcctgaggaaagaacagtgctcactgaaggaaaggaaacactcacggtggcgtccaggcaagagtgactggccaaggagccttccaggaagcccgcagggagcagttccgtttcacaggcggggctgcgggccacgcccactccagcgactccccaaggcagggggagtacagagttccaggcgccaccccgctgggaataaaagcaggctttccaggcagcgggctcggaatagggtcccgagctaccacccacttcctagcttgccgcaggggcacagtgaggcagtgctgatgtcaggcctctataaaccttcaggaatgctgcttattggaggaggttaaatttggtagaaggggtactagccttggtggcaggcagggctctccacccttgatccaggcaaatcagctcacctcgctgggcctcggttttctcatgcatatcatgaccctagttacacctccatgttactgtgtgcattgcacgagaaagtgcccatccatctgcagaccctggagcttgctatagggtggtgattctcctggttctgtgaagggcttagcctgaaggataaaaaggtgtggtctggttgggctggatttgaactcaggccctcagtgagcttgtagggcacctagtaacattgcacagtgtcactggggtttaagaatgtaccacctattgagctctgcccacatgccaggccccacgtggtgcaccttatgaaaagacacctgtttatcatgcagcctgaggaggaaagcatggagactggggcctgggtgtgagtttggcactcccctcaacctgcactgctggtccagtgggtggcaggagctgcctgtcccaccttgcacaggggggctcaagggaagctgaaagtgaggagacttggcttgtatcctgactcccctcagtgaggtgctccatctctgtgagcctgctgctgcccctcaccccaccaagatgtctgacaggatggatttgagaaggaggtacaacacacaccccatgatgcacggttggcccccacagactctgatgcaggccacaccctggcgctccctgagctggcctggttcagtgctctttactctcttagaagaacattggccgggcacggtggctcacacctataatcccagcactttgggaggctgaggcaggcagatcacctgaggtcaggagtttgagaccagtctggccaacatggtgaaaccccgtctctactaaaaatacaaaaattaaaaaaaaaacaaacaaacagaacagctgccatttgctgagcacctgtgacacactggggacttaacatctggcctctccctctggggaacctgcacaaacaaagcaaccttcaagagcccttcacttgatgctttaagcacccatccataatggcccttaattgactcttaattatactaacaaacactatgtgtatttccatgtaaaaagatgttacagaccaggctaaagtccataggccaccaccacctcagtccagctccagctcgtcttgctccccagggcatatccactgctatcagtttggctgggccctttcacacctccttctgtgcattactttgtgtatatgtgcccaagaaaaacctctttctctcctctccagaaggacaggtggagggaagcgccccagacaaggaagctggcaaccagccccagagcagcgatgggaccacctcgtcttgaatctgaccttgtccaagaaggctggacgagagaccttctgtcccctcccagagggggaaccctggcactggcccagcagcctcttctctgagctccatgtcccagataaaccaggccagactgagaaggctccccagaggcctctgtggcctccactccgggaaagccctctgcccacacccacaggcttcacattcccaccaccttcgcaccgtgcccaggtacactttcaagacactgtaaccacaagatgttatttattgagctggcgccgggacttgggcggggcctgccctacagtgagcagcccacacaggaacgctcctctcgcgagcggcccgggcagggaccctgtcccaacaccaacacctcctctccagcccaatcttctgggtccagacctgcttgtcccttttttagaaaacacttttaaactttttaaaaattttaaaccttttttcagcagatatggagagagctgacaatcaattcacattttttaagccattttagctaaactgtcattgtgcatctctgaggttccctcatggagctccacagatccatttttagggaagggattttggctcaaaacgatctgaccacctctgccctgtccaccaggataagtgacacctaggacccaggaaataaatgccgatgatttgtgtgactggtttaagattatttctccttaaccttgcaaaaacaggggttgggccttattttccccaagtccacaattagccggacttgccccaggcttctagaacatacgattctgagaagatgctggcgttctgcagaggccagcaccctccaaggccagtgtctgatgagccctcttccatctcatctgctctcaccccaactgccagcttcaggaacccaaaaggaagctttactccttaaaacctagagttaggaggggctgagagttcagggaatgtttgagcaacaaccagagaagccttatttcttctggaaggaggacagcctctggacccctcttggcccacagcattgggatctctggcctggcattcacagccacccttaggctcaggccctgctgctgagcaggctgacccagctccctccatgctcatcctgcccacatcggcccgcccaagaccaccaaattacatgccacctgctgcatgccaccagccatgggcttctttattgagcaccagattttcagtacaagttgccacagaaggagggtttcagattcaaccatgcccatgtgcaagggcgctggtccctggccagggcacataatcagagaagtgacgcggccatgccgaggtatacgtgtgtgcagaaatggacacatagggttcaggagcatcagtaactgactattgagatcatggtcttcttggaaggaataaatgtaaaaatgttgctcagccccacagagttggggtgactccacagggtgaaggcttggaggagtggcgtcttcagaggttctgccctgctcgttggttcagagaagcaaaaagatcaggcaacttgtagtacccaggatgttgtaaaaatcatagaacaccagaaccagaaaggaactccttcctatgatggcaagaagatgccttgccaagaccacataggaagaaaggagcagaacaggcctgggcccctctccctgcccttggctttgggcagccatggaggtgtccccaactgcccagacctttgggactgggcttcagaaagtctccccttagaacagcctctcaagaacttttatagaaaacaaaccgatctaatgagacgctgctcccagccagggcccagaaaccagggagtcatcacacattcatggcgctgcccaagaatggaagggcatcttgctagaagtcccacagaaagccacactggggccaggacagggcaactgcccagaagcccagacaggaacctacctgcagaggctgaaggtggcatcccataggctttatagagcaggtcgagaagctccctcttttcatcttctgggaggaaactagatttggccgcattgatgttctggaaaggccagaatggcagacaacatggaaccagagaacaaagaaggcagctcttagcaatgtagtgatagtccatcctcttcactcaacatgggcagatacgcttagagggggaaggatttgtccactgtcacacggcagcaagtgccagagtagagaccatgaggtcgtgttcttaatttgtcattacatgaaaaagggctgtgagaaggaagttggagaaacctttgagagacagggtggcatgtagggggccagagacacctcgcagacacgtgcaggaatggacttattcagcctgggatttaagaacaacctgaagagagtgtgcaagacttcatagctgctgcacacacctttctggggagagggttgacagctttcactggattctttaaaggcactcaacccaagcaaaggatcaaaaacctggtcctaggtcaggacgtcaacacaaagatgtcttctctgtggaaagtgtctaggttgggcttgtcttggactgttgaggcagactcactccctctctccaaagattccaggccccggactggacctgtagataccatactcccaaacccgagtcaaggccagtatggctcacacccactcaccagccttttaaactcctcttcagtaaagcccatgtcccgtttggtcatctggtaatcagtgtccagggtggacttgaagatgagcgggtcatctgtgttgagcgagtagttagcctggtcatttttgagcctgcagaagagggaggaggagagaatcagcctccttttactcttacataaatagtcagaacacattgacgttcacccgcctttgatcctcacagcagcctcaaacagatctgaaagatctgatccttgtgcagagggggaaataaattcagaacttaggtgacttgttcaagtctatgtaaccagaaagtccagaatccagcccatcctgaagaccagagctgggcaaaggcagcagaggggccagacatgggaaccaggcagaatggcagccggtgggggcgtgggggtgggagccaagaaagcaacatccccctccggctgccaccctctccagccttcccctctgcaccctaccctgcttgttcctcagtcccactgggagctggctactccaacataccatggaagctgttcttggcacgatccctgaccaccatcttgttgtatctaatggatctttcctagctctgaccataatcgacttgcatagcagaatttcacactgttgactgtttcttgaaaccttttccctggatttctgtgacaccacacttttgactttcctcctacttgtctcttttgctggtcccttaaataccattgtccttctgggttctatcctaggcccttcttgctccaccacctcctggggccactgcttctccttcagccaccatatctgtgcagatgactcctggatctttttccagcccatggtatacccacatgcctccaagaacctccacaggtgccacgtgtccctaaggcaagccccaagacccccttgtcatcagaacatcagagccgaagcccctccccttctcatatgcctggcagatggataagtgctggcctgaccatggtcaccctgagttcttgctgtccttgtcttggggaaggcggctttttcctaaggcctgatactgctcctgtggcttggcgacaggacggaaggagggccttgaccctggttagactccaggatgggagccaggcagggtggaacagaccctccggtggaaagcttcaagatggcgctcaggggaatgcccaggggtcccaagggccaggtgtcaggaagagagaacatgctggccagagggactcctgcttcctatgcgatgcccagggggcagagttgggagaattggaagtgtggaagcttccctcagagtaatggagcgttctgctccagctgatgagctgtagggccccagctctgctggttagcagctgggtaatcccagtcaagccacagcacatctgggcctcggattcctcatttgtaagatgaggacggcaatgcctgcttcccagggtgtcgaagagatttcatatctaaaagacgcggcatgggctgatgcccaatccctaaagtttcttccctctttggccttcctggaacaaaattgaacaggcccaggggaacagagctcaccgaatgactgcatgctccgtgtccggcttccaggcaccagtgaggtagctggaccaggggcagatctggaagagcaggtgtgtggctggcagggatggccccaggccatgctgattcctccccccatgtctgggcctggggccacccctcgagttcctgggacccgccctgctttctgcctctctatacaggaagttgggacagccggggatggttcctccccactccctggcccgcttacctcgaagtgcatgttttcctgccgcagcctgttataaagggcctggtcttccagggtgtggtagccgtgtcccagccgctctgtcttgagtatgtccacagcctgtagagaagcagaatagagccaagtatgggaggaggcagtgaggagggaccccatggccagcccaggccctcacctcttttactacttcggccgagcccacctccccggcgtggacagtacggtgaatgccgctcttcacagcctcctggaagggggagagccaggtcatgggtgccctagcgggagggccccggcaggccctgccttgaccatgctgtggagattgaaccatcctagtcatgctgcctgcttcaacagcatggggaaacctggtcttttaccctccaagtccttatctaagtggtagctgtcactcattagccagttaccatgtgtcaggtagtatatgaagtgacttgtatacattatctaatattcacaactattatcccacccattttatgatgaaggactgaagctcaggagattcaagtaatgtgaccaaggtcagacaggaagtgtggaaccaagctctgagcccgggcagtgggactccagagccctgacttctccaccatgctgcaccctccacaggaggcccattcatcatcacgctggaagcgacttttgagatgtcggctccaactcagtcatcccaatagaagaaacagaggcccagagaagacacagtgttgcccaggttcacacagcaaatcacagccagaagcaggctcagcacaggactcccaacaccaagtggaggcttttctttctctctcccttccttccttctttccttccttcctccctccctcccttcctctttttccttccttcctctctttctttctctttcttttctctttcttctttcttccttttttttttttttgagacagggtctccctctgtcacccaggctggagtgcagtcgcattatcacagctcactgcagctttgacttcctggactcaagcaattctcccacctcagcctcccaagtagctgggactacaggcatgcaccaccatgcctgactacttttttttgtatttgcagagatggatctcactatgttgccctggctggtctcaaactcctaggctcaagcaatcctcctgcctcgcctcccaaagtgctgggatcacaggcatgaaccaccacgcctggcccagggggattccagttccaagccttaagacccaacaaagacacacttcagaactcaggagacaccatggtccctggttcttgtgatttctcccaactatgggtgggagacaagctcacccagggccagcctctccattccttctcacaggacccacctggtaggcctggacatgtccaggcaagaggctgcttcctgggatggtctcatctccagccaggtcaatggctaccacggtctgctgctggtacttcttacacagctccaccaccttgggggaccagtctgtgggcgagatgcccacccaggctctgtcaccagcaccatggagagacctcccagcctacctgcctgctgtcccacccaaaccccccatgggaggccagcacaaaacagggctcagtgtcttcaaatcctaactgctatgtcctaaccacatggcctgcggaaaactgctctgcttatggcctcagtttccgcccttttcagaaagaaccctgccagctattgcacagggtcacggccaggctttgccgaggccatgtgtgtaaagcaccaaggacggggcctgagctcagtaaatgacacggacccttctctcacctggtgtttccaacaacactcatggtaggcttattcccatgcgcagatgaggaaacggaggaccgtttaacacgtcatctaaaatagaactcacactagtattgggaagtatctcgctaatgtattaggtactcttaaccaataaagttattctgaagtgtttaagaaagaatgaatgaacacaggctttggaactagatgtccccggatacaaatccagggtttgtgccttgcaagaggctgcacctcactccacctcagtttcctcatctgtcaaatgggactaagcaatggtagttctgctttgcaggctgctgcgaggattagaggaaatgcgtgcaggtagctctttggttcttactaatcctgagggtagaggaatgaagtaagtgtgatcatctccttgtgacagtgcacaactgaggtgtcttggtgcataaccagagcagcagtgtgacctgcccaatatcacacagtgaggctgtgcaccatgaggcacaaactctagagatctgatctgcgtcagtgacaagggagacccctcagaaatcttggaaatcagacctattcaggcccagacaggatggggcctggtccactgggtctcgagggaggactatgggctgatcagaatctagcctagatttttttttcaatagttacgttcctatttggtgttgagcttcctgcagggtggctataaaggcatggtgtccctggggagaacatctccagaagttctgagcctgcctaggaggtctccagttgtttcatgaagccccaagttcatgccagtgggctcaaggggacaccatggggctgtggggcacaggggagatcaggtacagccccactgctaggccaggaggtcagggccagggtgagacgggcggccctgggcagggcggtgatcctactcactgggctggtggcgcatgcagcacaggatggaccgggccttgaccccgaagtctcgctccccctcctgcaggccctggcccactagggccaccacctcgtctggggtgaggtcccctctgtgtgaggagaggagtagggatgggcctgaggcaaaaggaaggcctaaagggcagctctgggactgggacagaggaggaagaggaggctttggggaggaccctcctcccccactgacccactgcctcagaggaaagactggcagagatgcccccaggccctaacatgtccctctagctcttaaagcagctgggtgctcctagatcttagtgggaggtgtggggtgtcaacatggccctccccacccccagatggacagcattgctaagcttgggcctgccatgatgttcacattctatatgtatcagaatcatggctcagaaaatggggcagggtggttttgtgataccacttagagatccatgggggcccaggcagggggctagaaatgggccagactcacttcagttatgaagttagagcaggacctttagggcctttagagatctgatcagcatcagtgacaagggagacccctcagaaatcctgggtggctaagcaggttaacattcctggacagcaggcctgtggccagagcaagacacagccaaacacttgtgcccaaggtaagaacataacggcaaagggaggatgggaaccacgtctcttgtgacagagttaaacccatctttctgaggccatggaccagactgggggcaagaacaaggtcttgcttgggtcagggattcccagcagttcgcccttccagtctcagagctgagcctcccagccacaccctcagcatggccccttccaggcccatcactcactcagcctggttccaggggattggctccactttggagttggccagcaggtgcggactgtaccgcacctccacatacaccacgccctctttggccttcatctctacaaactcataggcgatccttttgatagcctcccggcagcccctgggaagggaagaaaggggttgggaacaaccttccccaagtcccttgggagctccaggagcaaatgacatccccaacccttggcagattaaacccacttcatcccccagacccaagctctgggcatccactggataagatcccagacactgggcaagtcctatcagctctactttggaactgcataccagttctcacccctccatcctggcctgaatcacgccatctctaactggcctccctgtctccatgcttgcccctgtcatcctgttctccacccagcagttggggcaatcttttaagaaggtaaatcaaagcatatcacttctcccctcgaagccccagtagcttcctgccacggagagtgacatcgcaactcccaggtcctgcccacaaggcctgcatcctccaggccttgccagcctccccagcaccttccttctccctcattccctgaggccaccggagaagacacaggcctgctcttccccgatactgtcctacactgcgtctctcccgctcccctggtttagagccagctgaagcttcacctcctcagagaggccttccctgaccaccttatcttttttttttttttttgagacagaatcttgctctgtcgcccaggctggagtgcagtgg[134 bp omitted]tttcgctgtgttagccaggatggtctcgatctcctgacctcatgatccgcccacctcagcctcccaaagtgctggggatacaggcgtgagccactgtacctggcccagaccgccttatcttaaaacggcccctccaccattctcctgggctttctttttctcccaggtccttatcactactcaacattgtgtgtcatatggcttatcagccagtttgctgtattccctactagaatgcagtctccatgtggcaaggacccctctgtcttgggatggctgcgacctctcagctgaggaccatgcctaggacagagtagcccaatatttgttggtgatggagttaaggctggcagggaagagaaatgagagaaaaggacacagctggacaagtccagagggatgcctggatgtgggagacacgtgggatacagtcatggacttggatccttgtgcccacacttatctgctgtgtgacccctggttagtcaccctctgacacctaggtcaaggagttattgcggggacaaatgagtcaaacttcataaaccccacccgggtcagtgcttggagcagagcggacaaatgctcaaaacattttcgttgttattactgcatgtttgttccagaagcaaggcacaaattggcctgccagggccactgtgttgatcacgtaacggtggactgtgcttagctggaagttcccaccatgaagagtgaaaatgaagtggttactagaatgtgtgagggaaggcacacaagtgctgggagagcccagcgtgggaagaaagtgccctgcccaggggagatcaggccactctcaggagaaggggtcaccagaagttcttgcatcttcaggatgaggatggaggccaggcgcagtggctcacgcctgtaatcccagcattttgggaggccgaggcgggcagatcacctgaggtcaggaattcgagaccagcctggcaaacatagtaaaaccccatctctactaaaaatacaaaaccattagttgggtgtgatggtgggtgcctgtgatcccagctacttgggaggctaaagcaggagaatcccttaaactgggaggtggaggttgcagtgagctgagatcgcaccactgcacttcagcctgggcaacagagtgagactctgtctcaataaataaataaataaataaataaataaataaataaagcagtcatggaaatttctctctagtactcgcccataccccttctgggccttttcggtacctagtgctgttccctggcgactcaagacaagaaaaagaaaaagccttttggagaatcttccccacatctccccgcccccaccctatattcaggcctctcctcccctcacaacacgaagccctgaactaggagatagatggcccgggttcaagccctgcactgcctctgaccctgtgttcttagctcccatattctgccatttctctgtagaacttgaagcaatttcagtccatcacacccacatctcagaagggaaaactgaggcctaaaggcactggagagactcactaagtgtacacaatggtgagaaagacagctgtggtttcagagcaacttctctggcccccacaggctgagggacaggcctggtcctagtcatagggatcaatgctgccctaggacctgtgggttgggggcaactcacgcgatagcaggcatgtagtagtcaaacttggccaggaagtctggaagggtgagcggcttgtccatgccaatgacgttcagcagcccctctgctgtgttagctgggagggcgatccctctcctcctggaaacaaaacagtgagtggtggaccaacccggggcaggatccaggcaggcctgacaggccaggatggagcagactcaggagcgccagcctccttgcaggaccacagcaggagacatgggcgtctctcagtccagctgctcccactggacagatggggaaactgagaaccaggaccggaatttttccagcaccttctacccccaatgcacaagtcagcaaatctcaagggggataaacaggttgaagtgtgtgtgtgtgtgtgtgtgtatgtgtgcacacatgcacacaccccctccatatccttggttgactgatgcttggagacaaggaaagtgccaggtcaagttcatggcttcctcctcagccccaggagctggctcagccagctggtcctatgcccagtcaggggttatcaggggcagtaactgcagcatcacaattcccagggtaggggcaggcatcaggacttcaccctccatctggctggcacatcagaggcttgcccagcccagcgcactgggagagggccggtggaggctcaggggaggggcccagtgggccgccagccagctcagacctctctcccctccctgcccacagccgccacaccaagctggactacagcagcgctcagtaagagcgtgctggaaacagcccctctggcttggagcctccatttctccccaagcatctcggcctcccctcccagccacgggaagcagggtgcgagctcaggggggctccctctcttctgcacacgctcctgcctcctcatcccatcccggctctgctccagctcacaaggtcacctcgagcctcagtttccccccccttttttttttaagatacaacagccagagaacaccagacattaagaaatgcttctaggctgggcatggtggctcacgcctgtaatcccagcactttggcctcccaggccaaggtgcgaggatcatgaggtcaggagattgagactatcctggccaacatggtgaaaccccgtctctaccaaaaatacaaaaattagttgggtgtggtggtgtgtgcctgtaatcccagctactcaggaggctgaggcaggagaatcacttgaaccagggagtcagaggctgtggtgagccgagatcatgctactgcactccagcctggtgacagagcaagactctgtatcacaaaaaaaaaaagaaaaaaaaaagaaatgcttctaacatgagggacaaaacaacagaatagacaaaagcactccgaggaaacagcacagagaacagatgaaaacctaagaaccaaaacaaaaaagacatgaatatcctcaaagagatgagaagatccttgaaaggagggaacattcagaacccaagaacgagccctcggaaatttacaagagaatgcggcagcaactgtcacgatgtaagaaaagaactggaagctaaaagtgaagaaatcctccacaaagtagaacaaaaagacaagatgatgaaaaataggagtaaacagttaaggaaattagaagattaaatcaggaggtccaagcatccaattatccacaaagcagaagcagaaaaataggaggccgggtgcagtggctcatacctgtaatcacagtactttgggaagccaaggctggcggatcacttaagcccaggagtttgaaaccagcctgggcaacacagtgaaaccccttcaaaacaaaaattcaccaggcgtggtggcgtgcacctgtagtcccagctacttgggaggctaaggtgggaggaccacctgagcctggaagtcaaggctactgcgggccaagattgcaccactgcactccagcttgggtgacagagcaagaccctgtctcaaaaaaataaaaaagaataaaggaggaaagtgccaaagaaacagaagtttgaccaaatagtgttttagtgtatgtaagtaagtttgtaagtcctttaatagcttctgttactaaaatattaaaatgcttccctacataaatatgtttcctaagccccctgaatgtgctcccttccccatctgttagcccaagtccccatgagtgcccagagggtaccaccaaggggtcatgctggtgcccaccagcctgctagtcagcccctaatcactgctccttaccagcccctaatccctgtaagagcctgcaggggaacggtgccctggtgcggcattggcacctggaggtcggagctcagtgcctcaggtacccctgagactgcttcccctcccactgctggccagctgccccaaagtcaccctcacaaggccttgcccagtaactgtggccgctgaagagcctgtaccagttgtcaaacactgttggggatatcactctgggaactgctgggtagaaggcagggagatgacactagggctctggctcccatattgccaaacccagtggccacatttgcctgggacctgctgcgccagccatgtgcgattctcctaatggtctccctccagcccccagaactccacctgcgggggctctgccctctggtcgttctctctcagactctgccttttacacacctggccaggccaactcatctcctttggtggttttcagctccggatccagaggtccacagcttctaattctctatgcccatacaccaccactgagggcctgtgatgtgctgggcactgggcagatagcagtgaccaagacagacccatgtgtctggctacctgttgagaggcaggcatctcgcgccacctttcccctccctctagatcactcccttcctgggttccacatttccaaatacggctcctccatctacccagctgcccacaccagagacgggcgcctccccgtgcccagcaccagcccgtcccctagaacaaattattttgctttctatttctcctcttcgattcttcttctccagcctccctcctcaacaaccatcaagaaggaacttctcaacacagagtttagacagagcagccagggaaggcctctctgaggaggtgacatttcagcagaagccttggggtgggggcagttctgggcaggggaggggtctgtactaaagctgcaggcaggaagccgcgggcattggaagtgcagggtggctggaggtcagagagcaggcatttgtgcagatgatgcaccagggaggcagggccaggctgggcttaggaagggactggggctttggctgaaagcactgggaaggcactgtaggatttcaagcaggggactagcatgaaataatttacctttttgaaagctcctctggctgctgcgtgggaaacaaattggagggaagccagagctgaggccagagagctaatgtgggggcccgacaggagacaaagagcacaggggactcccagtgtctcccatgggacacagcttcccgaagctgctcagactgagctggaaagcgcccatctggagcccaaagttgaagcaggaaagagctgttcctagggccctggcacctcttgctgtccctggccacccacacaagcgaaggctcctcatagggccaccctctgttttttcttttgttttgtttttttgagacggagtcttgctcttgttgcccaggctggagtgcaatggcacgacctcgactcactgcaaccttcacctccctggttcaagtgattctcctgcctcagcctctcaagtagctgggattatagatgcccaccaccatgcctggctaattttttatatgtttagtagacacggggtttccccatgttggccacgctggtcttgaactcctgacctcaggtgatccacccgccttggcctcccaaagtgctgggattacaggcgtgagccaccatgcacgctctgttcttagatgatccctactccctggtcagccacagctgctgtgctggggcactgtctggtcctcttccggccttggtgggcaacacagtcacaagaagcccaccatcaggagcccagggagggagggaggatgagctcaggggttgcaggtcaagtccatctcccacccctatttaccacatcatcccaggcaggagcgctcccctctaaggcccttggtgcccttgtcagtaaaacataatattttccatgtaggggtgcacagaggaagaaatgaaactttgtgtgtcatgagaaagagcagactctgaagcccagtggtctgggtttgaatcccagctctgtgacttaaaggctgtgtgaccttgggcaagtaacccagactctctgtttcctaggtctggcatgtttgaaaaacatccagtgtggactaagcaaggagccttagagaggtcagagaggcaatgcaggctttgcagaactttaaggcccatgtgtggactttggctttgactctgagtgagatggggaagctggggaatgagctgggaagaccatgggttaaggctcttgctccaactacagcactgcagggcccgtagagaggaaggccagagtagatggctgagaccaatcaggaggccacagcaccagggaggggcagtggtggcccagaccagggcagtgatcggaggaaagagcagccagtttcagaatctctgtagaaatagttgacagggttataaacaagactgagaaagaggttggagaggcccctgaaaaggccagaatcctgggaactggaggaaggagaaatgggtgaggacagttaatgaggcaggcctgagtcccagagctggaaaaagggccactgaattgggcctagcagggctcaggccaggggctcccctcctccttccattcttagcccatatttgtgtgcatttacagacacccatatctgagtgtgacaaactccccagtcccctgcctgctgacttcaggccaagctccagctggcacctgccgcacgccatctccaaggcccagaggtggtgtgaggaatggacgatcagaccagtgcccctcccggcggctcctttcccctttctcttagccccacccggcgctcccagcccctggctgcagctgatgagccctccgtgaccccttaatgagtgcctgggttcgatctcatcttggtgccccactgaacgacctcattaggggccttgtggcaagttggcggcttgacatgggcaaaggccaggcagagataagccaagaggtttcaccccacttagagatataagctccaattaataagaatattatcattaagtgacatttatggagcacattaatgtgtgctaggccctgaactaagcattttacgggcgtcacttaccaaaacctctaactgacagggggtaatggccagggccatggactcgggggcagactatctgggttcaaacctccgccctgtgcttactgggcaccttactccacctaccacggctcagtctcctcatctgtaaatgacggcaatagagttcctatcttacaaattgttgtgaggcttcaataacttaacccgggtaacgcacttaaaggagtgtttggcacacaggaggtgctactgtgcttatgccttgcagttaaataggaattaaatcaatggcagcttcctggggcagaagaaggtccctggaagtgcgaaaagatggagaatagtggacttaccagaaatctctcagggagttggtggagatgctcccgagagttgggggcaaccccccgggatccctcattctctccatgagggcaggcctctgaataacaggattctggcttatggagcagaaatgttcaaatttgggtcccgagctgaatttcaagactgtgacagagaggctgagttctttcagctccaaacaaaatgagtgttgtgcaaacatccgaggaacacaggtctgcgggggcagggctgggtggacaaggagcccctagctcctaggtcatctctctagggagggcctgttcttagcctcagttgatagagaccaagttcgcagacaggagataatatgtccaaatttgaatccagatccactggcctttaaagtccctgcccttaaaagctggtcctaagagaggagctgctgtgagcccttgaggtctgggtaggaagggaagaaccttcctcgctggggaacagggggaccctctggccccctagcatctctgagagctgaggcaggaagtgtgttctcacttggaagatgcagagatttaggcccagagttggggagccacttttccgtgactcctagcaggttatgaccctgatgatgtagtaaagccttaggggtcagacagccttgggttcaactcttgatctgctattaatttgtgtgaccgtggacaactgtcttggctgagcccattccctcctcagtaaaatgcagagagcgtatcctcctcttccaagcgtggaggaattcaatgagctgataaagcccagcccagctctaggagatgctcaagaaattgtactggcatctcatgtgagcacatcacctgctatatataggctctcagttaagtcaaaagacaggagccaggcacagtggctcatgcctgtaatcccagcactgtgggaggccaagctgggtggatcacttgaggtcaggagttcgagaccagcctggccaacatgtgaaaccccatctccgctaaaaatacaaaaattagctggatgtggtggcatgtgcttgtaatcccagctactcaggaggctgaggcaggagaatcacttgaacccaggaggtggaggttgcagtgagccgagatcatgccactgcactccagcctgggcgacagagcaagactctatctcaaaagaaaaaaaaaaagacggattcagccctgggaactaccttcatgcacgtatgtgggtgggtggggagagcaggctcaggcctggctcacctgacaccaggaggacaagactcagaggcccagaaagctcaggagttggtctgcgggtctccagctcagtgctgaggcctccatgtcctcacagtcccacttctggcctggagctggcttgattcccacagggagacaggaaggaacagtgaccctggaattccccaggggcctctgggtggagctggggaccccactcaaatcccagggagagagggctcttctgtatggacttacctgccatagtataagatggtttcaggcttgatggatccgtctaggtggacatgcagttccacctgcaagggggcagggggaagagagagagaaagggagagagagaacaaatacctatgagttcacgaaggacctttcagagcttaatgttaacattaatcatgataaccattagccaccattttactggctggctgctgaccccatatacttcggtaaactctgtactgcactatctcatttaatccgctcctgggatgtgggttcagctgttatctcgatctctttcacaattgaggacactgaggttcggaggtgttaaatatctcatccaaggccacacagattgcaagtaatagaggcaggagcccaacccagtatctttgttcttaatcgcagctggtgagtggcagaggcggaattctaacccaagcccaattccaaagcttgtgctccaggtcacgtaggcagctcccgctctcagccaactaaataaactactttaacaaaagggattgacccagatgtcccaaactagggaagagtcacagcatatttcaaaattcaggatccattttcgttttcttttttttgagacggatggagtctcgctctgtctcccaggctggagtgcagtgacatgatctcctctcactgcaacctccacctcctgggttcaagcaattcttgtgcctcagcctccggagtagctgggactataggcaggtgccaccacgcccagttaatttttgtatttttagtagagacagggtttcaccatgttgctcaggctagtctcgaactcctgacctcaggtgtccacccacctcagcctcccaaagtgctgggattacaggtatgtgccaccgcaaccgacccaggctccattttcaaaagcagatgctactcaagcatagcctatcaggaatcaatattaggcaacggaagatctttctagtactctagagtttaagagtaggatccttggaggcagcccatctggcttgactcccagttctgctgtgtgacctcagacaagacacttgacctctctgagcctcagtttcctcaactgaaaaacaatggaatattatgcccccgtgtccaagaaaaattgtaaggattaaaaagggcagtgtaggtggacatggatagcccaaaggaaacagcccctgccgctcagtcagggtgtttaccatgagctgttaggagaagcacagcaggcagtgggagatggtggggaaagggactttgctgttcctgctgttcctgttccaaatgatggaagctttccccctagctaggggagatccagaaaactctcagctgacatctcatgctggggtggggagcatggagagctggataagaaagttggctgccctggctcagggaggaacagccaaggagctgctggcccaagggcgtctaggagcacatacatgagctgcctcctgcagaggaaacccaacccaggcccaggggaggccagcagggaacagagacaccagaggtcctatcagcaggacctcagagtcatcagatctctcctgaggtcatccagctggcaggggacagagcggtcttcacacccagtctcagggccaacttagttgttgaattccctgacaaaatgagttcagttcccacccagccaaacgtctgtttctcgggttctcaaaatatgctcagcattgggaatactgaagcttatagcccagggaacggccaaccagctgtgtgacctcaggcaagggacctcaactctctgagcctctgttttctatccttaaccctcacagggctatggagagggcccagccagagagccggagtcacactgtatagagcatcatgcggttagagctggaatctcggctcctccactcactccctgcttgaccctgagaaagtcacttcacttcctgtgcctcggcatcctcatctgttaagtggggagaatggcagtccttccttctaggcttcatgagggttaactgcattagtaggcagggagttcttggcacatagcaaatgctaaatagttgtcaactaaaagtcaatgaaggctgggcatgggggctcacgcctgtaatccagccactttgggaggccgaggtgggtggatcacctgaggccaggagtttgagaccagcctggccaacatggtgaa[131 bp omitted]tacgccactgcactccagcctgggcgacaagagcgaaactgcatctcaaaaataaaaaataagaataaaataaaagtcaacgaaggcctgcgctcctgctggatgctagattgtagagttaaacaggagggtccaagtcctgttcctggggcttgtacaggccccagagtgggagaggcattaagcaaatgtcacatgggaaaatgtacagtcacaaaccaagacgactccttgggaagtacgaacacagtcctatgacagagggtaacaaacaagagaagtgaatacatctagagggccaacaatgagcctgagcgaaaagctagaggatagcgaggaacccacaacacaaggcaggggtgcggagggaggcaggaagaaaattccaggcagaaggaacagcatgtgcaaggccctatggcaggagaaaacggggtatatgaaatggattaaatagaggttcagagaagggagggttcatggtactggagaggctgcaggataggaccacccaggcagggctgtgcgggccacgaggagtcaggctttatctggaaagcacacagaggccattgcagggttggcagctggttagagaaagaggatggctcctccaaggccagttagaggctactgcagccatttgaaagatgacggtggcttggaccagggttgtgaggtgcatagaggaaaaacaggtggatagaaagagatgccaaggctcacacttcaggttaggcctgggtggggagcaattcccgcagtttgagacagagaactctggaagagaagaccaagtcctggagctccctccaggagggaggatgcgggggagggaggcatgattggtttggttttagttatgttacactagagacaccttttgttttttgtttttttaagacggagtttcactctgttgcccaggctggagtgcagtggctccagctcagctcacggaaacctccacctcccgggttcaagcgattctcctgcctcagcctcccgagtagttgggactacaggcacccaccaccatgcccagctaatttttgtatttttagtagagatggggtttcaccatattggccaggctggtcttgaactcctgacctcaagtgatctgcccacctcggcctcccaaagtgctggggttacaggtgtgaaccatcgtgcccagccaactggagatgcctttgagatatccaaaggtaagtggaagaacccagtgggatacaagagtctagagctggcctgagaagcccaagctgggaatgtaggtaggagtgtgggtaagcacagaagctgtgggcttgaaggagctcacctagggagaaaatatcaagggaggtaaggaaaaggcctaggatgaaactttgaccagcacaagcacttaatggccttacggaggaggctgagcctacagaactgtggccagagaggtgggagggtgtgtggtatgcagaaggccaggccgtcagatgtcaaggagaagcgagcaacggttcacagggttagcatagtgggctgaatggtggcccccacaaagctgtctacatgctaatcctaatccccagaacctgtaaatattaccttatatgggtcgggcgtggtggttcatgcctgtaatcccaacactttgggaggctgaggtgggtggatcacttgaggttaggagttcaacaccagcctggccaacatggtgaaatcccctctctattaaaaatacaaaaatcagccaggcatggtggcatgcacctgtagtcccagctactcaggagactgaggtaggagaatcatttgaacctgggaggcggaggttgcagtgagccgagattgagccactagcactccagcctgggcaacagagcaatactccctctcaaaaaaaaaatattaacttatggcgggtggatcacctgaggtcaggagttcgagaccagcctggccaacatggtgaaaccccatgtctactaaaaatacaaaagttagctgggcatggtggcaggtacctataatcccagctactcaggaggctgaggcaggagaattgcttgaacctgggggcagagattccagtgagccgagattaaatcactttactccagcctgggtgaaagtgcaaaactccacctcaaaaaaaaaaaaaaaattaccttatatggcaaagtgtgattattaaatgtcttgacaggaagagtttatcctggattatctggttgggccctagatgcaatcacatgtatccttataagacagaagcagagagttttaagagaaacacacacaagaggaagcagcaacgtgacctcagaggcagagactggaatgatgcagccacaagccaaggaatgcctagagccaccagcaaccagaagaggcaaggaatggattcccccgagagccttcagtgggcatgtggctctgatgatatcttgatgttggacttctggcccccagaactgccagggcacacgtttctgttggttgaagccatgcagggtgtggcaacttgtcacggcagccacagaaaactcacatggtcaggccctgctggaggtcacaggatggaagggcagaaacttgtccgtcgggctaaaagcgcaggcactgggggcttcagaggagtagttcttaaccccggctgcaagttaggagcacgggaagttctggccagttcccaaggcctcaaccccatctgaggtcaattaaagaaaaatccttggtggcaggcccaggtggaggactttttttaaaaaaacacgtagtcaagattgggaaccactgccgtagaggaaccgttctagaggcctgagtgagggtagaatccacatgggaataaggtaagaaagaagtggaggtaagaagaggaagaaggtttagactactctttcacaattttgcccctaaaggaactagcagccttggagggggcaggacgtgcatgtgggtcaagagaatggcaggctttttcaaaggggcatgtcttgggcaagtttaaacacccatggggatgattgaggctgagtgaaaggagttgcatgaggttactgggaaggtaggaggaagtcagaaagtcagaaggtcaaaccaggcctggccttggagcccctgagaacaggaggatcaggcagtgaatgggggcggtagtcacgtccgcttgtgggtgggactggtggggggaggtctgcatggctacttctggctaaagtatttattcatttatttatttgttgttgttgtttttttttttttgagatggagtctggctctgttgcccaggctggagtgcagtggc[133 bp omitted]ttcaccatgttggccaggctggttttgaactcctgacctcaggtgatccacccacctaggcctcccaaagtgttatgattacaggcgtgagctgccttaccctgcctggcaaaagtatttaaatgccaattcaagagcccacctcccagctctgctttactctggcacaacaattggcaatgttcagagtggaatcttcccatctgcctggggccctgagtgatccaaggagccgaaacctcactggaggccctggagggacaagcagtatgaggtcaacctgggtctctgcagacccctcagacctgggggctgtttgttaccacagcagcacaaggtagcctctcctgcctcagaatgagcaaacacacctttctgaactcagccttgcaaactgtgataagaagcagaccaagtgctatgagataaagaaaaatcacactggggtgggggcaatttagaaagtgtgttgggaaaagatcacttaaagggggagttcgccagggagaagaaagaaggagagggagaatggctccaggcaggggagctgcgtgtgcttagtgtctgaatcaggaagcaggcggggagttggccagagtgcagagtgaggttagtggtgagaaatgaggccagggcaaagtggagagggggcagggagattgcagaggccgaagcaaagggttttccacccaagtgtgttaaatcggagagtcccctttaaaaaaacctttcccggctgctgtgtggaggacaggatggcaggaagccagaacagaagaccagctactgcgggagggaagatctgattgggatttgaataacatgcgggaagtactcaaggcagcgtcagagacagtgggtgctcagcggggcagaagccagacagtgccggggtgcagaagctaggggttcagggagctgggcaggaggcaggagcgcctctgggaagggggaaagcagagccagctgcccaccatgaccagtagcactcatcccttctcacggctgcctgagaagaggcccagacgcgtttcaggtgtggagcagaggcaggaagccacctccacaggtggctcaagctcaggcaggcctcctactgaattttctagaaaactgcaacacaccatgggaagtctgtcagcctattccagatgacaatgacaatggggtggcgaccccgctctcctgtctcctttcagggaaaagggtcagcagtggcctcaaacttttgagtatctactatgtgctagaccatctatatgcattatcttatttcatccttacaaccagcaaggtagagacttcactcccattttactgatgaagaaactgaggttcaaagaagtaccccaaaacagtcagtgatggagtcagaatttgaaccctagtctgattcttgagctcctaaccactctactgtactgcctctgtgggcctagcctcagacatcaataatacagaaataataataatgataaagcagctacctactgttttcagaccctttatctcatttaatccctaggcaatgtacatatcggcccatgttacagatggggaaatggacttgccaggctaagcccggagaagttcagtggcctgtccagagttacacaaaattgatggtggtagagctagggtggaactcaagtccctctgcctcagcccaagccctgcccacaggccacaccccctccctggcactcatgtcgagacagtgcctggcctcctgacctctccagaggggaatctcacgccccttcccactgcctttgctctctgcaaggctgactcacagccagcccagcatttgtctgaacagcaggaaatcctcccagcgctgatgtgaacaggaagcatcctcagttaccaacaaatatttactaagccccactatgtgccaggcaccgtggaggccctcgggaaatgcactaagtccctgctctcaagagatgcgtgccagagaggtccagggcggtgggttcacttacccaaggtcactcagtgtgtcggtggcagagctaccatgaggacccaggtcttggactcctgggacagatactcccagatctgactcatgtttccacgttcccaactgctggagggcgagcagggccgtctacctccaaggcaaacctagtcagattagttctccctggtgagccttggggacaactaatctgactgggtttaccttggaggtagacgccctgctcgcctccggcagttgggtttgcctcccaaacacatcgctctgttttgttttcgtctgactttttgggttcatgtatgtaacatgtctgtctccctcatgagccgtttgctgagaggggggaccttgtctgtgtcatcatgtcgtgtcctcagcacctcgcacagcacctagtgctctctgtgttcaatgaccacaccgttatttcctcgtttccctgtcccatgtcagcaatgctgggtgctctccctgcaacaaggaaggggctgacctgcccccatgggacctggcagaacccacacgggggcagaggagccagggctgcctggtcagctcacagaacctgagcaccgtggccagaacccagatgagccacaggtgcccactgccaatcgaatgtcccctccctccctagccctgcttttggtgatgagctgggcagtgccagggtcagtgacttatgccactatggcctctcaactgacttttagtgtgaggccaggagacagagcagccctgggctgagaaactgtttcagctccacttcctccaggaagccctctatgctcagcctcatctaggctccgccagctccgaggtacacagtggaagggactgagcagtccccacagtgtctcctgctgacggggcctgacagctctgctgctgagaggtttcacagaaggcaagatgtgtcttccacctggggaaattcctgtggagccacagcatagggactcagcacacttaaactcgttttaaaggcaacaagactgaggctcagagagtgggaggaccttgagttagaaagtctaatgcataccacagccaggaagctatttgactctaaacccggaggtctagcagcacgctccctgcatgccacatagcaaggtgctgggtcactgatgctaacatctaaacaggggccaggtgcggtggctcactcttgaaatcccagcactttgggaggctgaggtgggtggatcacttgaggccaggagtttgagacctcctcttcacagaggtggaagggaggaccagcgggggcaagtgtatcccaagtcccagctacttgggaggctgaggcaggaggatcgcatgaacccaggaggcagaggttgcagtgagccaaaatcgtgccactgcactccagcttgggtgacagaggaagactccagctcaaaaaaaaaaaaaaaaaaaaagtcactgaagtcacctggtacccaggactacttcaaggacagccattgttatggccaacatggtgaaaccctgtctctactaaaaacacaaaaattagccaggcatggtggcgcacacctgtaatcccaactacttgggagactgaggcagaagaatcacttgaacccgggaggcagaggttgtagtgagccgagattgcaccactgcactccagcctgggcgacagagtgagactctgtctcaaaagtcaaagtaggaccattaccaaccatgatgatgatgctgaccaatggcagctattgctgcagcacctgctctgagccaggcctgcacttggtgtttgagaggtgggtatgggtataattctcattttagagaggggaaactgaggcaccgtgaagttaaatgactcattcaagctcctctagctggaaagtgggaaatcaggactcagacccagagagcctgaccccagctggtgtccaagttcaaattccttgctgttctagctccctggtcactaggagtgcagaggttatcccccacaactgctcaggggcctgagaacattaagggctgagggcaagcctacccccaacaccttgggtaaatacagattccaacctcactctgcgcccacagcctgctcctctccacctccccagccagaccatggtcctactaccttgccccgccccagggggtaccacagggaccccttcaagacacctgagcaggtggacaagtctctcctggatcacagggcccccagccacccaggtcaagcccaccctgaggttgaatgcaggattgggaagctgcctggcctcccctgcctccctgtgtgaacacagaccacttcctctctctgatcctcccttcctcctccgaagcaaaaggcttcgatgaaactcagtctcctttgttcccctccaccaccaactgccatgtgagtcaaaatgggtaaggcaggctcttcctaggcacatttttgttttaacaggtggctctggtaactgaaagccactgcaagcccaaagaagtgcagctggtgggttttgtgtcaggaagacaaaaaggaggagggaggagggagattctgcagctggagaggcctcccagagtctactgcaacccccactccagtccccaggaaggaaacgcacccctgagggcctgctgttaccagccaggcactgtacaaaaaccaatcagcatgtcagtttccccaagaaccccaagatcttggttttgtcaccccattttacagagggggaagctgagtttcaggagttgtctacctgaggtaccctagctgctaagcggcaggcaggaattcaaccccagtacatctgaagcccagggctaatgcactggcccaccctgccaccctgattctaactcttccccccacactgccccctcttttttgcataaagtggaattggcaaatgagcaaagcaatgaacagcttctacttgagtgcaggcagatctgggttcaagtctagctctgctgcttgccagctgtgtgactttggcaagttccctcccctctctgagtctcagtttcctcataataagtgaagttaataataggacaggaccttcctcagagggctgacataaacattaaatgagtcactgtatgcaaagcaggacagcgcctcgtgcagagtagacattcaaatatgagacagaaaaggcacattgctgatttagccccaattcccctctgcatcagagagggacagtttagaaactgctgtcccttggccgggtgcggtggctcatgcctgtaatcccggcactttgggaggctgaggtgggcggatcacctgaagtcgggagttcgagaccagcctggccaacaaggagaaaccccgtctctactaaaaatacaaaaaattagccgggcatggtggtgcatgcctgtaattccagctacttgggaggctgaggcagaagaatcacttgaacctgggaggcgaaggttgcagtgagccgaggtcgtgccattgcactccagcctgggcaacaagagcgaaactctgtctaaaaaaagaaaaaaagaaagaaactgctgtcccagcctgtacctgttcacttgccagtctacagcttcaaggctctcagattttgtgtagccctggcaagtccctccactccctaagcttcagtttcttcatctgtaaatggggatgaagacccatgccttgtcaagtcgtccagaggattccgtgagataaaagttactagccgggcacagtggctcacacctgtaatcccagcgctttgggaagccaaggtgggaggatcacctgagatcaggagttcgagaccagctggctaacgtggtgaaaccctgtctctactaaaaatacaaaaattagccgggcgtggtggtggacgcctgtaatcccagctactccggaggctgaggcagaagaatggcttgaactcgggaggtggaggttgtagtgagccaggatcacaccactgcactccagcctgggcaacagagtgagactgcggcacacgcctgtagtcccagctacttgggaggctgaggcaggaggatcgcatgaacccaggaggcagaggttgcagggacccaaaatcttgccactgcactccagcttgggcgacagagtgagattctggcaaaaaagaaaaagtcactgaaggcacctggtacccaggactacttcaaggacagctattgttatgattattgtaacaggcatgtgatcagcactggcctccaggatgcagaatgcctgagtgcctggtgccacctgtgaacataggctgataagggccacccctgcaacccccctttccacttcttccagtgcccagcaggtgctaagtcaaaccaggtgggggtatgggaggcacacccgacagggcaaacttgacttgggcatcccctgacgatgaccctgcatggcaggcacacttgaatgggtgttcagagttctgagcgaaggaatccaagagtggccaacctggagatccagtcgttatctatgaggaacatctgagccccaccccattcccacgggacactgaccatacaggggtatagggaccgaggccctttgttttgggttaaatgaaggttactaggtggagatggttgggagaaggtgttaaatgaaaatgctacataaactgcatgatttgcaagtggttgcggttcttctgctcagtctgccgccactggactctcttccctgtgtctaagcccccagtaaaaccccgtatcttgtttgctacctcttccaaagaaggtagcctcttgaacctggtgctatatccattggagtcaataggggtcccgcacaacagaaggcagctgcctagggccttgctaagcaaagtgtgttcctggatcgttgacattagcatttcctgggagctggtcagcagtgcagcatcgcaggccccaacccgacccacacagaatcacagtgtgaacattaaaagtcaggccacttgagtgcagtttgaaaagcgctgccctgctctgctttcttctagctgaccaggtcccaggcctcagctggtggcaggtatgagaagctgaaggacacagcaaaggctcctgtctcaggaggtttgcacctggggcactggcacctctatccccaaaggcttctgcagaggtagtttaggaaagatggttagaggcatgggatttcgaagccagcctcccttggactcaaaccccagattggacatttcctagctgtgtgatcttgggcctagttaacctctctgtgcctggattaaataaaaaatgcagataatgtgtttagaacggtgcctggcacagaaacatcaacactccattagctgcagctagtaatgctaataattataactgtcatctgtccctcccacaagagggcagggagctggctctggtcacagtggctctgagattcacactccttcccacttctcctgccagctcacacaagttcctcctcacaatcatacaagatttgtcacgcctcaaacacatggcaggtaacattctaccttcactctcaagcatcaccttgtggccttgggactcaggacacgggacacccacataagcagctgatgttccatcctccaggtgtggacactgaggtcccaatagggaaaatgatctgccagcttgaatcagatgggaggactgagcaaggccaaaaaatggggataataatatgagcccctcccttgatgggctgttacagaagaactgcaaggatccaatgggtgtctgcaacaagtgctctagaagtgggccctgctgttctctccataactcccaacatgttcgcaatcaaggagcctttttttttttttttttttttttgagacagcgtctcactctgtcacccaggctggagtgcaatggcgagatctcggctcactgcaagctccacctcctgggtttatgccattctcctgcctcagccttctgcgtagctgggactacaggcgcccgccaccatgcccagctaattttttatatttttagtagaaatggggttttgccatgttggccaggctggtctcgaactcctggcctcatgatccacccacctttgcctcccaaagtgctgggattataggcgtgagccactgcaccccgccaatcaaagagctttgctattgccataggattcacatcagggtacagtgggtccccagcccaagggcagagggagcccagagcatttaataaaaagactgcaaaggggaggcgccaatcatgggccccagctccagtaagacgtgaaggaggcaggggtgggggtaggagggcttgtacagcacctcagtgcttccagcttctgacggggagtagctgagcattttccctgggctgggggcatcagtagtgggggccaggcctcaccctcctcagaaggtaggtgggctctccacagcctgtctccctcactgacacatgcacactcactggattctcaccggcacttttgtgatagctgtcatcatcattcacacctatttcttttcttttctttttcttctcttttttttgagacagggtctcgctctgtctcccaggctgaagtgcagtggcaccatcacacctcactgcagcctcaacctcctgggctcaagcgatcctcccgcctcagcctcctgagtagctgggactacgggagtgcaccaccacacacacttcccctaactttttttattttttggagagacggggtctagttttgttgtccaggctagtctcaaactcctggactcaaatgatcctcccgcctcagcctcacaaagtgctgggattacaggcgtgagccaacctcctgggccactcacacctatttcttagaagggtaagttgaggctgactgcagctgactccttccccaaccactctcacaccctactggctgactcaccctgcttggcagactcctgggcccctcctctcggactctgcgacaggccaagggggtccagaccctccctgaccccaacagtcccaagacgccacagctggtgggcggagaaacaaggggattctcccctggggccagtggccatggcttggcctcgagtgaaccctgctagggccccaaacccagggcctacctagctcctgttcttcccgcgcgggggaaggggggtgctctgctcccctccctcccctttctggcagggctcacggttcttccccggggcgcatccacaaacctgagctccttggcgctcaccaccataacgctggcgtacaaagctgcttccattcactgagcactcagtaggcgccgggcacagcactaggtgcctatccggcgtagacatcgggcctgatcatacagctgagcttcagagacctcaagtccctgcccaggcccacacagcgctcagcggtgctaggatgcccacttgacagacagcgaaactgagacccagaggggtcaagtcaggggcagaagcagactctggaggcctccgggttctggaccttctctgccccattgtccctgattagcccgcaagcaagccacggcctaagccgaaggaagaactcgcctgcaggagcccccgttcgttcccagggtttggacgccccgggctgggccccgctaagcccctcgggccgcccaggcgccggacccccgtccccggagcccccgcgcgcgctcactttgggcttgtcgaaggcgggcgtctgggccatggtgccctcgtgcgccccggcgctgctccctccgccgccgctcggtgggtctctgccggctcggtggccgctcggctttccctggggccagcggtggccgcggccggccacgctcttcttaacgggccgggccccgcctcccgccccgcccgccgccgttcccggggcccgccctctcgccggagcccccgccccgcccgccggcctggatcgcgcatttcctggaattctggacccggcgtcctcgcccgccgacccgaaaactacggccccgcggcgcccgaccggacccacctgtgggcgcgcgctccagccgcctcgctgggcgctgccttccccccggctcctccagcaactttcaagcgtccccctgcagtctgggcgctgctgtgcgccaggcccaagctagaagcggggaccccgggagcatcgcaagcctcgagcggcgtgccttccaccggatagacggacgctcgtcgcagaaacacacaccataattgtatagttaaggaactttcgaggggggccagccgtggcctgcagaacctgcaggagttcatcaggggtgggtgggggtggagaggacattctacgtgagagactccagggagctgggagtgaaaggaggcgaggaaggctggagctcggagggagggagaacacagacagtcccctcctgggcattcacctttaagaaacccgcccaggcgcagccagagacctgtgcagaatgttcacaccagcgctattccgaataacaggaacattggaaacaccctcaaatgcccctccacgggcgagtgggcaaataaaccggaatattcacaccatgaaacgttagacagcagtgaaacggaatgaacttcagccagacaacaacagaaacaatgtctcagaaacaatgttgagtgaaaaaaactaagttgcggaaaactgcatacaatggtgcaacttttagaatgtgtaaaagcaaaaccaaaagtatgtatgtttagacacatgcatcggtggaaaaaatgtaaagcaagggaaagatgagcatagatacgagaagagtggttatctcaggtgaaagggaaggagccgggaggaggtaaggacggagggaaataacacgcgggtacaggttatttatttatttatttatttatttatttatttatttatttatttactgagacggagtttcgctctttcgcggaggctgcagtgaagtggcgcgatctgggctcactgcaacctctgcccctctggcccgcctcctccccaccgctcccccgcacccccagcgtttcaagcgattttcctgtctcagcctcccgagtagctgggattataggcgcccacaaccacgcctggctaatttttgttttttgtttttttgtttttgtttttgtttttttgagatggactcttgctctgtcgcccaggctggagtgcagtggcgaaatctcggctcactgcaacctccacctcctggattttaagcagttctcggcctcagcgtcccgagtagctgggattacaggcgcgtggcaccgtgccctgctaagttttggatttgtagtagagacggggtttcaccatgttggccaggctggtctcgaacacctgacctcacatgatccacccacctcggcttcccaaggcgtgattacaggcatgagccaccacgcctggccacacacaggttattgataatgttccagtactggggtggatggtagcttcatttcatttcatcataaataaattaacaaacccataaacaagggggaaagagagagtgggagagtggagagcaaggggctagaaggtctgatgggagctgaatcctgccagggatgtgggacccagcgatggtgtgggattcctaggaagtcagtggagtgttttaagtggaggcgagacaaaatcacccttttatttggaaaaaatattctccagctactgaaagtgtgatccagggatcatcagcacccacatcacctgggagctgactacaaatgcagactttcagaccccatcccagacctactgaagtagaatctgtattttatacaaacaggacccccaggtggttcgcacccacagggcactttgagaagcctgggctccctgctgtgaggggagggcattacagggggccagcgggggtgagggaggacaggataccaggaaggaggcaactgccatggtctgggtagggcatagtgatgtcagtgggggaagtggagaaactcatattcaagctgcatttagggtgtaaaatcagctggatttggggtttggttgtatgtgggagtgagggagagggtggctgtattagtccattattttcatgctactgatgaagacatacccgagcctgggcgcagtggttcatgcctgtaatcccaggactttgggaggccaaggcaggaggatcacctgaggtcgggagtttgagaccagcctgaccaacatggtgaaaccccgtctctactaaaaaaaaaaaaaaaaatacaaaattagccaggcgtggtggtgtatgactgtaatcccagctactcgggaggctgaggcaggagaatcgcttgaacctgggaggtggaggttgtggtgagccaagattacaccattgcattccagcctgggcaacaagagcgaaactccatctcatgaaaaaaaaaaaaaagacatacctgagactgggtaatttacaaaagaaagaggctttaatagacttacagttccacaatggtggggaggccttgcaatcatggcagaaggcaaaggaggagcaagtcacgtcttacatggatggcagtagacaaagagagagcgcctgcagggaaactcccatttttaaaaccatcagatcttgtgagacttatttactatcacaagaacagcatgggaaagaccatcccccatgattcaattatctcccgccgagtctctcccacaacatgtaggaattatgggagctactagatgagatttgggtgaggacacaaagccaaaccctatcagtgggtctcatacattgtcaaagccaggggagttttttgtaagatcctttcttggctctctgtgttactcgggttcaataataggggctgccatttactgagacaggtttggagccaggtacactgggaagcactttataagcacccatcccatttcatctttacagtcatcctcagatgtaggaggtgttctcctcattttacagatgaggacactgaggttcagatagagagacagcctgcttggctcatgggttgtaagtggcaaaactggggtttaaatttgaatctgactcgagaaacttcactccccaccttattgcctccccagcctctcatgacattcaagtccctcttcaacatcagtcccaccacttcccaccacattgctgaaatgccaatcaacctagatgagttgctggttgcttaagggtgacacaaattatttgcaattcttcacattgcaagatggagtctaggtttcctcctcttggacctgggctggcctgagtgacttgttggagtaatagagcgtgatgggagcaagcttcctggatttccgagccttggtcataaagaagctttgtggtgtcctttggggcctcttgaacattctctctgggaacccaagcttctagaagagaccatcatgctaagagagtccacatatggccattccagttgacagtcccactgagcccaggcttccaccatccctacgaagacagcaatcatgttagcgaagctgtgttgggccatccagcccagctgcccactgaaaaccaggctttggtcaatgccatgtgggacagaagaattacccaagtaagcccagcccaaattcctgacctatagtattgagatatgtaatgaaatggatgttattttaagccattgtgttttagggggagattgtcacacagcagtaggtaacaggaatgcttgcttctacctgccccagccctccagcctctgcaccttagtcacttccatcctgacacctggaaaaccctttacccagatcctagactatcaaaattctgcattccaaatgggtcagatccaaagggccaggctgcgtgatgcagttcttctgtttgcccctgcaggtgcactctccacccttctgcacgctgctctgctcctctgtgtccggcagccatgctgctgtgggtgagaccaatgggctctcctgccctctggctctggttgggttttgtcaacagggagcaccagcaggagaacagcagatgagaggagagaggtcaggatattcattccccctttccctcggtgcacagtcactgggctgactgtgtctctctaccaaggccacatctcctgtcagtcctcctggcccacctctccataccctccccattccagattccctcttgcctattgattgattgattgattttgagacagagtctcactctgtcgcccagggtggagtgcagtggtgcaatcccagctcactgcaacctccacctcctgggctcaagcaattctcatgcctcagcctctggagtagctggaattacaggcacccaccactatgcccggctaatttttgtatttttagtagaaacttggttttaccatgttggccaggctggtcttgaactcctgacctcaaataatccacccaccttggcctcccaaagtgttggcgttacaggcatgagctaccgtgcctggcctcctgccgttttcttgaaaggcagtggttccctttgttaccagagtcccacgccacccgttgttgctttccttaaactctcctcgctaggttcaggtttccccagaagcagagcctgagacaaagatttcaatgcaagtagtttatttgggaagaggaaacatgggaaggatgtgggtgcgaaacaagacaggaaaggggaagaagctgacatgagcaggtcaccacactgagcacctggagctctatccctgggcagcactctgggagatgatgaatatgttgcaggcttaacccagcagaggagcgaggaagctggggaatctaactgccccctcccctctggcaatgcttccaggacattaacttcctggcactcttagtttgttcaacatgaccggctgagtttcttgcatggctagaaaatatttgcagcaatgagagagagactctgttagcagtaagtagctattgccatgtagaggtgattttgagggcatatgggcagctacaccagcccacacctatgtaaataactcccatattaaaccctcttcaattactcagtttgagtgtggcacctggttcctgccaggaccccgagtgatacaggctggtcttgagcttcttcatagcaatacagagtggaccagtgactacagaaagcttgagaggggctggagagagatgccttccccaatattcattatccacacagcacgccactcctgtgagaagacaacagagattgtgtatgtttgagaatgtctctctacctccaatgtagccctcctgaaaaatctagttcaagatctattccaggccaggcgcagtggctcacacctgtcatcccaggactttgggaggccgaggcgggcggatcacctgaggtcaggagtttgagaccagcctggccaacatggtgaaaccccatctctactaaaaatacaaaaattagccgggcatggtggcatgcacccgtaatcccagctactcgggaggctgaggcatgagaatccctctgggccacagagggagactctgtctcaaataaataaataaaaatcaagatcaaaatgtatatgatcaggagcctcagctccaccacttacagctctgtggctttgggaaagttgttttgagccttgattttctcatctgtgtagtggggataacatatacatactaattaataggataaaccatagacacgcctcgctcataggaggagaagaacatcctcacacaatgggagaggtggggattgtggaaaggagagagcaaatgcctcgtcaagatgctgctgtgctgaaacataaatccagtgttgccagatcctccaatcatccaaaaaagccggagacccatcttttaatgtttaaactgtattcaaatgtgtcctaatgtttaaaactttgtataagccaaagaaaacatctgtgggccagattttgccccacacagccaaggtccctgctgattctgatcttctaagatctctgaataagaaagaggacaagggacaggttgccctttcactcacatttatcagacaggattaggatcagttgcacacaacagaaaacacccaaataatagtggctgaaaaaagacagaagtttatttctctgttgtgtaaaaaggccagaggcaggcaatgccactgatgtgacaactctgtgaagatgcctccttctatctctctgctctgccatccctagcatccagcccctatcctcattgtgcagtatggctgctggggcaccagccttcacatctgcagtccagagagcagggctgaggaaaggatgcagcagctagtgcttgtctctctttttttttttcttgagacagagtctcactcttttgcccaggctggactg[133 bp omitted]gatacctggttttcctcacaacaaattctgcttatatagtcacatggccacatctaatcgcaaaggaaactaggaaatgtcttatacctgtaaggcaaggtacccagctaaaaaaaaggagattgtgttactaaagaagaggatagtaggcccactgcagtggctcatgcctgtaatcccaacactttaggaggtcgaggtgttcgatcacaaggtcaggagttcgagaccagcctcacgaacatggtgaaaccccgtttctactaaaaatacaaaaattagctgggcacggtggtgcacacctgtaatcccagctaattgggaggctgaggcaggagaattgcttgtacctgggaggcagaggttgcagtgagccatgattgtgccactgcattccagcctgggtggacagagcaagactccgtattgggggaaaaaaaaaattagaggatagtagatctagaaggctgctcatttctgccacatcaaatagcctggtaggtgaggagggtatatggataggtggaaagagtgttaccaggaagccagattctgctgtccatatcatatgtctttaagcctctttctgaccaggagaagaaaataagagagcaagatagaaagaggcctgagtataatcatagagacaacttaccaaggacctgttgcatgccaggcccagcactgagtcttgtgccaacattgttttagtccattttgtgctgctatagcagaatacctggaactgggtaatttttatggaacagaaatgtattggctcatggttctggaggctggaaagtccaatatcaaggtgctggcatcattcaagggccttcttgctgcatcattccatggtagaagatgagagagtccgagagggtaagagagggagcaagagattgatctcacggcctcaagcctttttatactcagcattaatccacccatgagtgtggagcccccatgacctaaacacctcccatgaggccccacctgccaacactgttgcattggggattaagtttctaacacatgcttgttggggaaccacattcaaaccatagcaaacatcatctcagattattcttttcatccagcctatccggtgggtgggcctcgtgttattgtggggtggggtcacatcttgcctgtgccagctggggtaggaggcctggacatccaattgtctcccagattgataaccaacccacccttctgtcttctgccctacctgacaccacttggtcttcagagatttctggtccctccaatccctgagcctgagattctgcaatttgctttgtcctaaaggctccccgtgagcagccaggtttcaacttcctgggtttcttgtcagtccccactcaccatctgccttccagcttccggaatttggttgattcttctcatctgctattttcttcctcatacgttttctttgtcccagtagatagatgtgcatttaaaaaaaaaatccctgtgtcattttcttggaatttcagagaacaatggagagaaataagtgtgttcaacctgccatgtttaaacagcagtctccagcctcagttcttgactgggggaatcctcagccctcaggaggattgtatggtatccccatccttcccccattccttccttatcctgctccaggagtccatgggagccctcggcacacaggactctcttccccactctctgaacctggggcatagttctgtcctgcctccatagcccatacctgcttctcaagagcaggggccttgtcttcttctctctacttcgacaggtctgggcaggcctcaggaagatagatatgagctcatggtgtgggtcattcctaagaagtcactttggactttgaggagttaaaattcaaagctggggatgagagtcaggcatttctaaattagaatatcaagtgtattcccactgtatttacaatggaggccagcatcaacactcaaggtgaaagcctgatagagtcacattggtccttgaaaacctcttaggaagatgccaggtggagacagaggcatcgtccctcactgaatctgatacagccagcattttctccggggcttcttccccatgtcttgagtaagtgcctgctggagatcctggtttgggttgagaagctgtgttatgtagacaaagtgcatcttcagatcctagaatcttcctcagtgggtcatgagcctcatgttgctcataggaaaagaggccaagaactagggtgaccaaccatcctggtttaccaggtctgagtagtttattgaaatacagagttttcagtgctaaaaccaaaacagtcccagggaaattcccaattgtggtcaccctacagaacaaccgtaacaacaggattacctctcacacaccctcctggacatgtgcatgttacacaatttgtccactttctgttgctgtcatagaacccatgggactgggtaattgacaaagaaaaggggtttgttttttacagttctggaggctgggaagtccaagacagggtggctggatctggtcagcttctggtgagggcctcgtgctgtgttgtaacacagcagaatgcatcgtagggtgagaggaagcaagagaaagccgaggaagcaagagaaagccgaggaagccaaactcacttttgtaatgaactgctctcaataactcacccacttctgtgagaattaacccactcctgtgagaaaggcattaatccctcctaatgacctaatcccctcttaaaggccccacctcccaataccattacattggggaccaagtttctacatgcattttggaggagacaaaccacatccaaaccatagcacacacacaacataaaatcgttatctcctacagtttaccacacccctcaacctccacgcccctctcaccagccttttttttaatacgaattcttgctgttgttggcctgggctggagtgcaatgacacggattcggctcactgcaacctctgcctcctgggttccagcagttctcctgcctcagcctcccgagtagctgagattacaggtgcccgccaccacgcccacctaatttttgtatttttaatagagatggggtttcaccatgttggcagggtggtctcaaacttctgacctcaggtgatccacccacctcagcctcccaaagtgctgggattacaggtgtgagccactgcgcccggcctcaccagcccttttaagggaaatagatggtagacttgttcggagagtgggctctggaactaggctctggaagcttcagttgcagcattcattagctgtatgtgtttgggcaagtcactttacctctctctgcctcagtttccttatctataaaattggaagaataatagtaagttctactctgtcaggtcattgtaaggattgaatgaattaatattatggagagcagttagaacagtgcctgtcatggaggaagctacacaggtcacaactccttaactgaaactccagtgtctcaggatcctgatgcattttggaatttagggagttttgggattttggaaagcacatgacttatataacacactagtgggtagtgggatctggcttagcatcccataacgaaacacattaatatttctgcagaaaacaatatacgagtattcatacatctgttcaggttaggttttggctacccaatgagttttggtgttacattattttgttcagaaacactgggatctctgaagtgtggataagggcttgtaggtctgtgtaaggttttgctattattattgttgaatgtgcatctgatataactgccatgcagttgcttcttgaggacaactctgagcttttatgcccaaggccctcctggactcttggagttttctagcagggccttcctgcaccaagagctctgaataacctttgaaggctgacaggacactctcttcttctctctctacctaggtcctcaatttagtgatgtctccctgttcctctcagtgtggtaatagaggttggcaggggaggggtaggttgcaaatgcaatctccaggagccttccccagcctgaccctcaccccctcaaccccagctggtcccagtgggggaggggcacaggttgtgtggaagtgatgagtaagcccctcttctggtgaagctattgtgggttcaggcaatcgtctggcctgcacaggcaagataatggagtcaaaggaggcttatggcccctcagccgcccctgggcatgcacagatgtctctatggcacacactagcacttgcagaaaagcattggtgccaggtgcggtggctcatgcctgtaattccagcactttgggaggccaaggcgggtggatcacttgaggttaaaagttcgagaccagcctggtcaacatgcaaaaccccgtctctactaaaaatacaaaaattagccggatgtggtgacgggcacctgtaatcccaactactcgggaggctgaagcaggagaatcacttgaatctgggaggtggaggttgcagtgagccgagatcgcgccactgcactccagcctgggcgacagagtgagactctgtctcaaaaaaaagaaaagaaaagtgttggaggggaacgagaaagttcccccttaattctcagccagtatttactgagtgtgaccctgggctgggccccaggctaggtgctggggacacacagtgaggaaaacctggcccctctgagataaacccacaggccaggggcagctgccttctgacattgggggtatggggctggccctcaccctgaccatggtggcaggtgcccacccacccttcaaagcaagaggagggagggagaagtgcctgtatgttcaagagttactttacaaggacaaatgggtccatcaccttggttgacgtcagcaaagaagcatcagccaaagccttgaggtgaccccaaaagactggggtgcaggttagggggttgagacaggctcagcatggagagaggagggtaaagctcctgcagaggccccagctcccaaagatgaagctaccgcttgatgatgctgtctccagggccagagatcttcctctcatcccgcactatctgcagtcctctctggtgtgtgtggggcgcagtcattagacccatcttccaggtgagagatctctgcctcagggctcagaggacctcctcctggggtttcagatcagtcttccaggatggaggatgggaagcaggccatcaagagttctggtaagaaatgaggtttctagtcaggtacggtggctgacgcctgtaatccaagtactttgggaggccgaggcaggaggatcacttgaggtcaggagttccagaccagcctggccaacatggtgaaatcccatctctactcaaaatacaaaaattagccaggagtggtgaagtgcacctgtagtcccagctatttgggaggctgaggcagcagaatcgcttgaacccagaaggcggaggttgcagtcaactgagatcgcacactgcagtctagcctgggtgacagagggagactctgtctcaaaaaaaaaaaaaaagaaagaaagaaagaaatgaggtttccctgactgagtctgggaagctggcattcattcgttctttcactcattcattctggctgatcccgagctctgacagttcctatctgcatgaccctggcagctcacctcagccctgagcctaagattctactatgtaccaggcactcttcagtctacttaggatacagaaggagccaggtagtcatgacctccagcctcatgacgcagataatggggtgggggtaggggcaactagcttattctggaggcttcctgtaaaaaacaacgcttaagtggaggtggacagaatctccccatcacgctggggaaaggcagaaatggatttagcaaacttactgtgaaagtcacagcttaagccttagagcccctcacttgccaggggccttccaggggcctgggaggggccaagtaatgcacactcaggatcacatgctttagtagaatttgccaatgtaagatgttttaactgtaatttattaagactgctgcccctctcactccaacttccctctctgtcatacttccccttcttttgggtattgccccagtgcttctggcattttgggggatctagctaaggagaagttgtcacggaatactgacattgatgaaaataacaaaagtcaaaatacaccactacaaaaaggatgtaatagaaagcatcaattcaaaaaaattttaagattagtcatcaaggaaacataataagtccggaaatcttacagctccgatatgaaagaaacttgatagaggttcttccaaatttgacaacaatcctagaattttatgaccttccagtagtccccccttatcctcgagggatacatttcaagaccctcagtgggtgcctgaaaccgtggatagtacggaatcctatttagactatgttttttttgatccaatagccaagacaactactaagttgacgaatgggcaggtagtgaagatgctggacaaaggggcaattcacacccctggtgggacagggtggggtagagtggggcagcaccaaatttcattacgctactcggaacagcatgcaatgtagaacttaatgaattgttgatttctggaatttttcatttaatattgtcagactgtggttgtccatgggcaactgaaacctcaggaagcaaaaccttgcagaagagggggctactgtaccagtaataagttgcaaagctgaaagaaactttatcgaccataagaaatttggggccaggcacagtggctcatgcctgtaatccccgtattttgggaggccaaggtgggagggtggcttgaggccaggagttcaagaccaatctgggcaacatagtgagactccatctctacaaaatcttaaagtattagttgcatgtggagacacatgcctgtagtcctgattacttgggaggctgagacggggagatcctttgagcccaagagtttgaggctgcagtgtacaaagatcagacaactgcatgcctgcctgggcaatggagcaagaccctgccttaaaaaaaaaaaaaatgggggccgggcacggtggctcacacctgtaatcccagcactttgagaggccaaggtgggtgaatcatttgagaccaggagtttgagaccagcttggccaacatggtgaaaccctatctctactaaaattacaaaaattcgccaggcgtgcctgtagtcctagctactcaggaggctgaggcaggagaatcgcttgaacccaggaggtggaggttgcagtgagcctagattgcaccactacactccagcctgggcgacagagcaagactctgtctcaaaaaaaaaaaaaaaaaagaaaaaaaaattagtcaactgtgctagagaaaagattaaagtatcttcttattctctctaaagaaaatgacattacaaaatcaatgtcacatgaagaggttaacgtaaaagtatacaaacacaatgtaggaatgaaataattatagatatgtatcatattgatgaaaatatgaatgtaaatgtaaattttaatttatgtaattatgaacaaaaatgtaatgctattatgtaaataaatatatttattatgttacatgtaacttaacatgtttaataacttattatgttatgaactgttgctgactatgtggccacaacaggggagggaatcttgggacccttattcagagagatcaagaccaaataaaggacctaataagtcatttccttcaacctgtcaccagtgcaggaatcctcttcctgatgacagctgtccactgagcctcggctctgtacatttcctgggatgaggaattcacccctcctccaaatcctgtactatcttgggtcaaaactctggttgtgggaagttctttagtcaagctgatcactagctgtcggtggtttccccttgggtcctcatcttccccagcacccccagaaatcatgggctgctgcttcccattttattatagctctgcagtgctacaatgcagctctagtatcttgccctggcctgggataacctgcccttcttcaaagtttccttttatgtcttgacttccaaagtcttcctcatccatgatcgcagagattgatcagccactcatacatatatgaggacgacaatgatgatgatgataatgagaacagctagccagcactgagtgcttactgtgtactgggctccgtgctgggtgctgtatgagcacctgctgttggtctcatgcacacctatttatgttggttttgagtaacttgtgcaggtatacctttgatttaaaattttggtttctatttagactacgataggaatttttgttttgtttagccttctctcctaagcttaatgaaaccacatattcagaaagaaaggacacatttaattaaaacatttcaaagacacacagcttaaaagagtgattaccctagacctcttacaaacaaatatgcccctcctccaaaactcttcttaatgtaaatttcagagaggaaaagccaaaaacaaaaacaaaatcgagaatgtgtgttaatttatctggctaaaacctgataaaaagattttcttggccgggcgcggtggctcacgcctgtaatcccagcactttgggaggccgaggcgagcggatcacgaggtcaggagatcgagaccatcccggctaaaacggtgaaaccccgtc[133 bp omitted]cactccagcctgggcgacagagcgagactccgtctcaaaaaaaaaaaaaaaaaaaaaaaaaaaagattttcttaagagctctgtagttcaaagtcaacttaattaaaagcaggtattaagactataatttttaaaatagagcctttctgcttcttctattttggatcttgttttggggaattttttttcaggtgactgaaacccctcttttaattatatggtgagtccctctctctgttcgcttcctttcttgttggtgtgattttttgctgaaggaaaaaaaaaatgtaaaacttaagcagctttctggaaagcttaaatttattctctgtgctttgaaatgtaaatttcctaccttgtctaaaattcagtgaggtactcgcttcgcagcacatatactaaaactggaatgaaggccgggtgcagtgactcacgcctgtaattccagcactttgggagtctgaggcgggtggatcacctgaggtcaggagttcgagaccagcctggccaacatggtgaaaccccatccatactaaacataaaaaaattagctgggcgtggtggcacatgcctgtaatcctggctacttgggaggctgaggcaggggaattgcttgaatctgggaggtggacgttgcagtgagccaagactgcaccactgcactccagcctgggtgacagagagagactctgtctcaaaataaataaataaacaaataaataaataaaatgaaattggaatgatagagaaaagattagtagcatgtcacctgtgcaaggatgaaatgtaaattctgaagcgttccattaaaaaaaatatgttatttaataaaattaattaaggccaggtgtgatggctcacacctgtaatcccaacactgggaagctgaggtcaggaattcaagagcagcctggccaacacggtgaacctagtctctattgaaaatgcaaaaattagctgggcatggtggtacacgcctgtaagcccagctactttggaggctgaggcaggagaatagcttgaatccaggaggtgggaggctgcagtgagccgagattgtgccactgaactccagcttgggcaacagagcaagactctgtctcaaaaacaaacaaacaaaaaaatgaaaaaaaaataagtcacaaagggatcaaacttcattttggctactcctgctttggcgatggccacaaaagggaaaaagtttttcaaatttttttggtaactatgcctttagagttttgccaagctaaattaaactatgaatatttattgaagatctagatcatttccaaataagatataatgctaagacattaattactacatataagtttaagctcatatacttttggtttcttatttcagagaaacaaaagatatttaggggctgggtgtggtggctcatacctgtaatcccagcactttggaaagctgagataagaggactgcttgaggccaggagttacagaccagccagggcaacatagtgagaccttgtctctacaaaataaaaattttaaagttagccaggagtggtgttgcatgcttgttagtcctaactactcaagaggctgaggcaggaggatcgatcactcaagcctaggagtttgaggctgcagtgagctataatcacaccactatattccagcttgggcaacagagcaagaccctgtctcaaaaaaaaaaaaaaaagagatattaagatccgctagtaaaagtatcctattccacactgaaaaattgttccattagaaagcctgtgtttctaaatattataaaatgtgtattaatcaattgttagtacatagtgacaaaattacttctggctgggcggtggctcacacctgtaatcctagcactctgggaggctgaggtgggcagatcacctgaggttaggagtttgagaccagactggccaacatggtgaaaccctgtctctactaaaaatacaaaaaattagccaggcgtggtggtgtgtgcctgtagtcccagctacttgggaggctgaggcagaagaatcacttgaacctgggaggtggaggttgcagtgagctgagatcgcgccactgcactgcagcctgggtgacagagtgagactctaaaaaaaaaaaaaaaattacttcttagattttcagtataaattaagattactaagatttaaaattctgactaatatatggtaactaacactagagaccagaaggaagacaattctgtattcagaatatgtaaggaaagtaagacatctttttaggaaggaagattataagaaagacataagcatgtggtttttgttaaagagaaagtggttttgcctagtttagaggttatttaaaggctgtatgaaattgggataaaagaaggaaagaataaaatagattaactgaatggatatagaaagttgggaaaagaaagaggaatggaaaaattgtaagaagttataaaaggtttatagaaatattatctcgtgtggtcaaagctgattgagattagatgatttataaggttttattaaaattaggctttatatttataatgcattgatgcaaaagtagaatcatttttctattttgaactagatagtcacatagttttttttttgttcttttttttttttttttttgagatggagtctcgttctgtcacctaggctggagtgcagtggcgtgatctcggctcactgtgacctccacctcctggattcaagtgattctcctgcctcagcctcctgagtggctgggattattggcatgcgcctccatgccaggctaatttttgtattttgagtagagaaaaggttttgccatgttaaccaggctagtcttgaactcctgatctcagggtgatccgcctgccttggccttccaaagtgctgggattgcaagcgggagccaccgcaccctgcctcatatagtattaataagagatagcaaaagatttttttgtttaccttttgagtaaactgctgctaaaaaaaaaaaaaaggagaaaagaaacgggggagagggagagacattctgttggtctcaagttgtctttttcaggtcttttgtgtcaggcctctgagcccaagctaagccgtcatatcccctgtgacctgcatgtatacatccagatggcctgaagcaactgaagatccacaaaagaagtgaaaatagccttaactgatgacctttcaccattgtgatttgtttctgccccaccctaactgatcaatgtactttataatctccccccacttaagaaagttctttgtaatctcccccacccttaagaaagttctttgtaattctccccacccttgagaatgtactttgtgagatccacccgctgcccacaaaacattgctcctaactccactgcctatcccaaaacctgtaagaactaatgataatcccaccaccctttgctgactctcttttcggactcagcccgcctgcatccaggtgaaataaacagccttgttgctcacacaaagcctgtttggtggtctcttcacacagatgcgtgtgacatttggtgctgaagacccgggtcagagggactccttcgggagaccagtcccctgtcctcaccctcactccgtgaagagatccacttacgacctcgggtcctcagatcaaccagcccaaggaacatctcaccaatttcaaattgggtaagtggtcttttcactctcttctccagcctctcttgctacccttcaatctctctgtccttccaattccagttctttttcctctccagtagagacaaaggagacacattttatccgtgaacccaaaactccagggccggtcacagactcaggaagacagtcttcccttgccatttaatcactgcggggacgcctgcctgattattcacccacattccattggtgtccgatcaccgcagggacgcctgctttggtcattcacccacattcccttggtggcaagtcaattgcggggacgcctgctttggctgctcacccacattgcagcccagggctgctccccacccccttctccatatctctacccttctctttaaacttgcctccttcactatgggcaaacttccaccctccattcctccttcttctcccttagcctatgttctcaagaacttaaaacctcttcaactctcacctgacctaaaatctaagcatcttattttcttctgcaacaccacttggccccaatacaaactaacaatggttctaaatggccagaaaatggcacttttcatttctccgtcctacaagacctagataatttttgttgaaaaatgggcaaatggtctgaggtgtcttacgtccaggcatttttcacacttcgttccctccctagtctctgttcccaatgcgactcgtcccaaatcctccttctttccctcccacctgtcccttcagtcccaaccccaagcgtcgctgagtcttgtgaatcttccttttctactgaaccatctgacgtctcaccttcttcccagactgctcctcctcagctcgctccccaccaggctgaatcagcctccaactcttcttcagcctctgctcccacatcctataacccttctattacccgccctccccacacccagtctggttttcagtttcgttctgcggctagctctcccccacctgcccaacaatttcctcttagagaggtggctggagctgaaggcatagtcagggtacatgtgcctttttctctatcagacctttcccaaatcagccagcatttaggctctttctcatcagaccccactaaatatatacaggaatcccgatatctaactctgtcctacagtttaacctggagtgactgaaatgtcatcctgacttctaccctctccccagatgaacgggaaagagttttttctctagcccaatctcacgctgataaccgccggcttcatgaacctgacctccaggaaggcagtagagcagttccccgagaggacccccaatggaactatcaggcagattccccaggtatggctaggcgagattacatggtttcctgcctagttgaagggcttaaaaaggcagcttacaaagctgttaattatgacaaacttagagaaactacccaaggtaaagacgaaaacccagctcagttcatggcccgctcggcagcaacccttacacactttaccgccctagacccagaggggccagaaggccgccttattcttaatatgcattttatcacccagctcctgacattagaaaaaagctttaaaaattggaatccggccctcaaaccccacaacacgaattaatcaacctccccttcaaagtgtacaataatacagaggaggtagccaggcagcaacgcatttctgagttacagctgctcgcctccgctgtaagacagcccacaaccacgtctccagcatacaagaacttcagaacatccaagccacagctcccaggggctccttcaaaacatcctcgtggaccttgcttcaaatgctaaaagcctggccactgggcctcagaatgcccgcagcccgggattcctcctaagccgtgccctgtctgtgcgggcccccgctggaggtcggactgtccgactcacatcactgccactcctaaagcccctggagcccaaaccctatgttccttggccgactccttcccagatctcctcggcttagcagctgaagactgacgtagcccgatcgcctcagaagcctcctggaccatcacagacgctgagcttcgggtaactcttaaagtggagggtaagtccatcccgtttaatcgatatgggggctacccactccacattatcttcttttcaagggcctgtttccctcgcccccataactgttgtgggtattgatggccaagcttcaaaaccccttaaaactcccccactctggtgccaacttggacaacgttcttttatgcactctttttcagttatccccacctgcccagcttccttattaggctgagacattttaaccaaattatctgcttccctgattattcctgtactacagccacatctcattgcccccttcttcccaacccaaagcctcctttgggtcttcctctcatatcccccgaccttaacccacaaatatgggacacctccactccctccctggcaaccaatcacatgcccattactatcccattaaaacctaatcacgcttaccccactcaatgccagtatcacatcccacaacaggctttaaggggattaaatcctgttatcacttgcctgctacagcatgggcttctaaaacctataaactctccttacaattctcccattttacctgttcaaaaaccggacaagtcttacaggttagttcaggatctgtgccttatcaaccaaattgttttgcctatccaccctgtggtgcccaacccgtacgctcttttgtcctcaatatcttcctccacaactcactattccattcttgatctttaaaatgctttttttcactattctcctacaccccttgtcccagcctctctttgcttttacctggaccgatcctgacacccatcagtcccagcagcttacctgggctgtactgccgcaaggcttcagggccagccctcattacttcagccaagctctttcttatgatttactttctttccacccctctgcttcttgccttattcaatatattgatgaccttctactttgtagcccctcctttgaatcttctcaacaagacaccctcctgctccttcaacatttattctccaagggatattgggtatccctgtccaaagctcaaatttcttctccatccattacctacctcagcataattcttcataacaacacatgcgctctccctgcggatcgtgtccgactgatctctcaaaccccaggcccttctacaaaacaacaactcctttacttcctgggcgtggttggatacttttgtctttggatacctggttttgccatcctaacaaaaccattgtataaactcacaaaaggaaacctagctgactccatagattctcaatcctttccccactcctctttctgttccttgaagacagttttagagactgctcccacactagctctccctggctcatctcaacccttttcattacacgcagccgaagtgtagggctgtgcagttggaattcgtacacaaggactgggaccgcaccctataggctttttgtccaaacaacttgaccttactgttttaggctggctatcatgtctccatgcggtggccgctgctgccctaatacttttggaggccctcaaaatcacaaactatgctcaactcactctctacagttcttataacttccaaaatctattttcttcctcacacctgacacatatactgtctgctccccggctccttcagctgtactcactctttgttgagtctcccacagttaccattgttcctggcccggacttcaatccagcctcccacattattcctgataccacacgtgacccccatgactgtatctctatgatacacctgacattcactctatttccccacatttccttctttcctgttcctcaccctgatcacacctggtatattgatggcagttccactaggcctaatcgccacacaccagcaaaggcaggctatgctatagtatcttccacatctatcattgaggctaccactctgcccacctccactacctctcagcaagctgaactcattgccttaactcgagccctcactcttgcaaaggaactacgcactacgcatcaatatttatactgactctaaatatgccttccatatcctgcaccaccatggtgttaaatgggctgaaagaggtttcctcactacgcaagggtcctccatcattattgcctctttaataaaaactcttctcaaggccgctttacttccaaaggaaactggagtcatacactgcaagggccaccaaaaggcatcagatcccatcgttcagggcaacgcttatgctgataaggtagctaaagaaagagctagcattccaacttctgtccctcacagacagtttttctcctcctcatgggtcactcccacctactctcctgctgaaacttccacctatcaatatcttcccacacaaggcaaatggttcttggaccaagaaaaatatctccttccagcctcacaggcccattctattctgtcatcatttcataacctcttccatgtaggttacaagccgctagcccgactcttagaacctctcatttcctttccatcatggaaatctatcctcaaggaaatcacttctcagtgttccatctgctattctactactcctcagggattgttcaggccccctcccttccctacacatccagcttggggatttgcccctgcccaggactggcaaattgactttactcacatgtcccgagtcaggaaactaaaatacctcttggtctaggtagacactttcactggatgggtagaggcctttcccacagggtctgagaaggccatcatggtcatttcttcccttctgtcagacataattcctcagtttggccttcccacctctatacagtctgataacggattggcctttattagtcaaatcacccaagccgtttctcaggctcttggtattcagtagaaacttcataccccttaccgtcctcaatcttcaggaaagatggaacggactaatggtcttttcaagacacacctcaccaagctcagcctccaacttaaaaaggaggactctgtcaaggatacagcccaaaaactcaacaaccaagcaagtaattacgctgaacagccttgggcactctctaattggatgtcctgggtcctcccacttcttagtcctttaatacctatttctctccttttattcagaccttgtgtctttcatttagtttctcaattcacacaaaaccgcatccaggccatcaccaataattctgtatgacaaatgctccttctaacaaccccacaataccaccccttaccccaaaatctttcttcagttgaatctctcccactgtaggttcccatgctgccccaatcccactcgaagcagccctgagaaacattgcccattatctctccataccagccccaaaatttttcgccactccaacacttcaccactattttgttttgcttttcttattaatataagaagacaggaatgtcaggcctctgagcccaagctaagccatcatatcccctgtgacctgcctgtatacatccagatggcctgaagcaactgaagatccacaaaagaagtgaaaatagccttaactgatgactttccaccattgtgatttgtttctgccccaccctaactgatcaatgtattttataatctcccccacccttaagaaggttctttgtaaccccccccccgacccttaagaaggttctttgtaattctccccacccttgagaatgtactttgtgagatccaacccctgcctgcaaaacattgctcctaactccaccgcctatcccaaaacctataagaactaataataaacccaccaccctttgctgactctcttttcggactcagcccgcctgcacccaggtgaaataaacagctttgttgctcacacaaagcctgtttggtggtctcttcacacagacgcacgtgacattttgattgtttggaaaattcagtctcctctctatgaaagagtaaaagtttgctttttgaaatatttgaatcatcactttggctagatgaatgactacaattttaaactcactttgccaacacactgacattggcagagtgcaaagatggcaagaggctgggtccatggtgacactgttagggaaacaggagcataacagagtcagggtgacaccattttaaaatcaattgtggctgggcacagtggctcatgcctgtaatcccagcactttgggaggctgaggtgggcggatcacctgaggtcaggagttcaaagccagcctggccaacatggagaaaccccatctctattaaaagtacaacaattagttgggcatgatggtgggcacctgtaatcccagctacttgagaggctgaggcaggagaattgcttgagcccgggaggcagagtttgcagtgagctgagatcgtgtcactgcactccagcttgggtgacagtgtgacactctgtctcaaaaaataaaataaaataataaaataataaaatcaactgcatcttcaaactagcaaggcacattccttggcagtcacaactcatggccatgatatgttttgggtgaaggaagcgatttagtaatgcctgcaagggcaaactcctatggtggcagggtgtccagatatcctaatagcacataacaatatctgcttttgagataggtaaagtcatgctttgaagtatttcctcactaaaataccaaggataattttatttaaatcaacaaagcactaaattttcttttttcttttttgagatgctcactctgtcgcccaggctggagtgcagtggcacgatctcggctcactgcaagctccacctcctgggttcacgccattctcctgcttcagcctcccaagtagctgggactataggcgcctgacaccatgcctggctaattttttgtatttttagtagagacggggtttcaccatgttagccaggatggtcttgatctcctgacctcgtgatccacccgccttggcctcccaaagtgctgggattacaggtgtgagccaccacacccggcctaaattttctttaaaaaaaaaaaattattgtatttatggctgggcactgtggctcatgcctgtaattttagcactttgggagactgaggcaggcggatcacttgaggccaggagtttgagaccagcctgggcaacatggcaaaatcccatccctaataaaaatacaaaaaaaaattagctgagcatggtggcacatgcctgtagtcccagctacttgggaggctgaggtgggaggatcacttgaacccgggaggcagaggttgcagtgagccaaggtcgtgccactactctccagcctgcacaacagaaaggactccatctccaaaaaaaaaaaaaaaaaaagtatttatttatttttcatttattccaggcagaagaaacagcaaatgcataggtcctgaggcaggcatgcatttggcatgttggaaaacatgtggcactggccagaccaagcaaggccttggagaacatgaagagcagtctggcttttgctccagttgccacagaagtcactggaagaggcctcctctgagataagacactaagaaagcagtgtcaggccagttagacaggtctggacttgtcttctggagtcaaatgcaggcggcagacatttaaatggccagtcacagagagggtgatgggggccatgatgggtgacccacagggccgtgagagcacagaggagggaccctgccccatcctgagggcccaagggtccttcccaggggaagagagagctcagctgagacctgaaggctgcagcagagttagccagcttgaaagagaacgacaagggatgggatgggaagtggattccaggcagaggaagaagcaactgcaaacgcctgagaagagaaagcctggagcatttgggggaccagaagggggttaatgtggctggattgtagatgcaaacaggggttggcctggggggcaggcggcagcggctaggagggctctgcttttctcacttgatatactgtgaacatttttctatgtcagaaaggatccttctgctataggatttttaagggctgagcattacgtcgtggaataactggttctccagtgtcagacatttaggttctttctagtttttccctcttagaaacaatgctatgttgaacatctttgtctgtgcatctttgtgcacacgtattattatttctgtgcggtaaagttgggaagtctcggaggctacttggtggacaggattgagagctgccttggagaggcctgagtcagatctgtttgccagatcagcctccactgggtttctactggaggggccatacacagggagatgcagggagaaggcctgagggagagatagagagccctgattgtgagctgtggctgcccaggccagataatggcaggggagagaggaggccccgatcctgggcccctgtctgtgctgtcggcctggtgcgttagctcctggtgccttctaaagaggcaacaaaagtacttcaaattgagcatgagcttgggttcaaatcacacctctaccgctaaaaaactaagtgccgttgggccagttacttagtcattctgaatctcagcgtccttatctgtaaaatggggaaaataagccaatagggttattgtgaaagatacatgagattaatgagtcttggcgatagtccctgctcccagtaaatgacggcgtgcatttttattgtcatcttgggtctccatcctttttaaaaaaatacttgattataacagctttattgagataaaattcacatgccatacaattcacccatttaaagtgtacaattcaggcagggtgtggtggctcatgcctgtaatcctggcactttgggaggccgaggcgggcagatcacttgaggtcaggagttcgagaccagcctggccaacatggtgaaaccccatctctacaaaaaatacacaaattagctgggcatggtggtgggcgcctgtaatcccagctactcgggagactgcggcaggaggatcgcttgaacccgggagatggaggttgcagtgagccaaggtcatgccactacactctagcctgggcaacagagcaagactctgtctcaaaaacaacaacaacagataaagtgtacaattcaatagttttttatatatttgtcacaatcaattttggcactttttcattatcccccacagaaaccctgtacctatcagcagtcagtcctgcagccgacccccctctggccccaggtaactgccaattactttctgtctctatggatttgctctttctagatgtttcatagaaaagaagtcatgcaacatggggtctttttttttttcttttgagacagggtctccttctcttgcccaggctggagtgcaacagtgcaatcacagctcactgcagcctcgaactccagggctcacatgaccctccctgctcagcctcccaagtagctgggaccacagtgcaccgccatgcccagcaaatttttaaaaaattgtttgtagagatgggttctccctatgttgcccaggctagtctagaactcctgggctcaagtgatcctcccaccctggcctcccaaagtgctgggattacaggcatgagccagtgcgtccaggcctgtggtcttttatgactggctttgttcacttttttcatccctgtcagcaatgtatgagagttctgatttctctgattccttaccaacacttattattgtttgtcttttttattgtagccatcctcgtgggggtgtgtagtgggatctcattgtggctttgatttgcatggccttgacggttaatgtttctggtttttttcagtggaatcccctttataaattctgggacaccctattcccagtgtggaaacactaacctgttccaaagaaagaaaaaaaattctagatggaaaaagatgttcattactgcgacataacatttcttaatacaagtgactcgtctatagcagtaggtagttcctaatttttttttttttttgagacagagtcttactttgtcacaggctggagtgcagtggcatgatctcagctcactgcaacctctgcctcccgggttcaagtgattctcctccctcagcctcccaagtagctgggactacaggaacataccaccactcccggctaatttttgtatttttagtagagatggggtttcacaatgtggaaacactaggccacattgtgaaatgtggccaggatggcctccatctcctgacctcatgatctgcccacctcggcctcccaaagtgctgggattacaggcgtgagccaccgcgcctggcctattatctttaataattataaatactgggctgggcgtggtggctcatgcctgtaatctcagcactttgggaagccaaggtgggcagatcactggaggtcaggagttcaagaccagcctggccaacatggtgaaaactcatctctattaaaaatacaaaaattaccctgtcatggtggtgcatgcctgtaatcccagctactcagaaggcttaggcaggacaatcgcttaaacctgggaggcggaggttgcagtgagccgagattgagccactgcactccggcccaggcgagagagtcagactccatctcaaaataataataataattataataactataaagaccagctatcatatggaaaatgtccctgatgtgtgaacaaatgcaggatggaaaaatactcagtgtagtcattttagctaatatatatttgttaaaacatccaaatatttttttcgagctcggcgctgtgtgccaagctccatgctggctcatggacaaagtcaggaaaagaacaagcaaaaatgaaattccttcttgtgtcgggagtggtggggttttgggggacaggtatctccccttccccatgttttcttctcaaacttcctccactgttgttatattacctttgcagtgataaaaccaagagaacagaagaaatacttctggacctaaggatgaaagaatgatgggagaaacatttcttgagccagtccctttctgcgttcttattttgtggaatccgcacacatccccgagaagcttaataaaaagggctactatcatgacacttactgtgtgccttgccggttccacctgttaggtgccattgttgtccccattttacagatgaggaaactgaggcggggcaaggagatgcccttctgcttggtggtctatccttcagcattacccacacacatgcagagctacatataagctcacgttcacactcggattcacgtctgcacccatgggcacatggaggatcgcacaagccacactcagacacacatgtgtgctcacacacagggctgcccatgtccacaggtatgtgcatggggacacgcatgtatatatgtgcatattcccatatgcacacagcacaggtcaaacacttttggacacacatctgcctgagaatgggaaaaggggtgcaagataaaggggcaaagtctggcttttgcctcctccctgcacctgctaccagctgtgtgcaggactgggtggggcagaaataggtggctctgagctcagagggcagaggtggccttgcactagaaatccacctgccaaacttccaaatgggctacagcgactaaggggcctcacctgctgggcaaatcccccagctggagggtgtgctccagatcctccaggggtccccagggggttgagaagatgaggggcacacccagcagcccctaagggaggaagcgtggccatactggctaagggggcgcactcttcttgcaggccgcctgatcagatgcctgtaaaataagacagctttacaaagagggtgtcggaatgtgaggaggcagagggacaggcatgagtagaaagaccttcctcaggacctgaagtccaatgatcctggtcctgcgtcccactagctaggtgatattgaacaagtcacataacctctttgaacctcaatttcctcatttgtaaactttgcacaaatcatttctttgactgctaaacaagtatgttttgaggaccaacgacatgccaggtacggtgctgggcactgggaaaacagcagcaagcaacacagacatgggcttgccgtgtagagcctgcagaattagggaaaggataaatggaaacatctcacacatagtaagtgctcagttacgttcctcctggtctctcttttctaccattgtaaaggcgatgcaataacatagaaagttgggagaatggggtggcggttgctgaggggggaactctgtcatccagaatcccaccaccccaacacaatgactagcttcatttttgccaatttcatcagctcatgcaggggttgacctgctgtagggcactcaaaatattcaaaccaattaatgcattgcatttgtgatcagaagaaaaaagctaattacaatgtaacagatttacctgatgcaaagcaacgcaagcatggccatccctctgcatatatggaagcttttccttttgggggaaacagcaatatttccattttacggaaaaagaaatggaggcacagagaggtcaaggcacttgcccaaggtcacacagacagaaatgcgaagagcagctccagaggccagaactcctgcccatcctgtccaggactgtgggatgcatccagggacggacactggggctgtgggctggatgacttggctgcctttgcattgattggagctgtttagggaacctaccccagccactagcatccagtcctagagacacagaaaattcactggccagcctcacttttgagcccagaaaccccttacccttcctcctgcctcttgagaggccagtgttaggtgttagccggggtgcaaagctctggaaggcaggtttctgctttctgctgccctccagtgggcaaagaaagcaaacctctggatccatctggaagcaggtagcaggtgttgcccaagtcagctgcggctaatagtaataataatggctgccgctcaatgagcacttaccacgtgcagacgtttttacacctaatctaatgtaacctaacccctttaagcaatttaattaacatttaattcctctctcaaggtaggaatcacttcctatatacccatttacatacataatctgagacttagaaaaatgacttcccaaagtcacaaagctggtcagtggcagagccgagagtgcaagtccttggagatcagaggaggaagagaccatgatcctggaccaggagacagccctgcattcttgggcacagaggtgaatttactgtgaggctggtgacgcatcagggctcctgacttgcatgtcctctcccagggccatggaggaactttccaacgcattcgcatgggcatatgtttcacatttgcaaaactaacacatttcagttgcaattggctgagaccactatctctctccactgcctagaataatgtcttcacatagtaggtaataaatatgtgctaataaatccattttgtgtttaataaatcatgttgaatgaatgggtagagaaatgaaggaaggaaggaagtggcatttagttcaatcttgaaggaagggcaggatttgagagagcgttcctcatgtagcctagtgggcccctccacacacagaccatccaaggccatgagtggccttgaatgccagggtgaggaatctggccttaggtggtaggcactggggagccatggaaggttgcagagcagaggaaggatatgagtgtaattgtcaattaggcaagagttgaatgtcaaataagaggacagggccctacagcggggggccagagtggctcagataaaactcccctcatccagcaccacacagagagctggtgctcagccagtgtgatcacagaagcctctgctggggtgtctataagctccctggaagaagatatccaaatgctttgcatgtgtggctttgtgtatgtgtgtgtgtgggggggggaggggaggtgctgagtgtggatttgctcagcactctagtgtgcccagcccaacgtgggggaaaggtcaaggccctgtctggcttaggcagggagttctcagcattgcagtatgactgagcctctggctggaaagtaagggagccaagagaaaacaggtttagaagttggctaggcagaagtggacctatgaaattccagctgcaccagctgcttcttttgctaagctcccgtcatcctttctctctctccactgggtctttctgaatgtcaagaatcccagccactgtttagttagcacttgttttttgccacactctgtgaagcaccttcaagcccgatcaccggattattcctccaacaacgccgagagtgagaagaatggctattatttcgattttataggtgaggaagtagaaagcccagagaggtgaagttgcttacctgaggtcacataggagtcaatggtatacgtgagatcaaacccagactccagaggcagcccccctcagtcgccagccgtcctgcctcctctcctggtctaagctggggaggaaaaacccatcttggccagcagggggcggtgtgccctcaaggataagccctgcttcccagaactcagacagaatttgccagcaagacaacagcacgattctgaaatatctggctttgagccctcatttagtcccaactctggtggggcctggagaacggggagaggggtgagagaagtataaaatagccctcaaattggtgagccaatggttcacagaaaggaaagcgcagcggcattttaacatataaaaagattctcattttcactcctaggaagagaaacgtgttaaacccacaccacctgagcaggcactgttttgctatcaaactggcaaacttatgcaggtggggatatggagacacactccttcttacattgttggtgggattaaaacttggttttggccaggtgcgatagctcacacctgtaatcccagcactttgggaggccgaggagggcggatcacctgaggtcgggagttcaagaccagcctggccaatatggcgaaaccctgtctctactaaaaatacaaacattagctgggtgtggtggcacacgccagtagtcccagctactcgggaggctgaggcaggagaatcacttgaacccaggaggcggagcttgcagtgagctgagatctcgccattgcactccatcctgggcaacagagtgagactccatctccaaacaaaccaaaaaaaaaaaaaaaaaaaaaccagaaaagaaaacttggtttaacacctatagaagctaatctggtaacatctatcaaaattaaaaatgcacatatctaacaggtatgcatgatacattcatcaaaagacttgaactagacctgcatgatctgatgtggagccacccaccacatgtggctgctgagtccttgaaatatggctgatccaagcctggctgacatggcaaaaccctgtctctactaaaaatacaaaaatcagccaggcgtggtggcacgtacctgtagttccagctacttgggaggctgaggcacaacaattgcttgaacccaggggcggaggctgcagtgagccaagatcgtgctactgcactccggcctgagcagcagagcgagacagtctcagaaaaaagaaagaaatatggctggtcaaattgagatgtgctgcaagtgtgaaatatatatgggattttgtatactaacaaaaatgcaaaatgactccttaataacttgctaatattgatgatgtgtcgcaataatattttggatagattggattaagtaatttttatttttgttttttatttttttgagacggagtctcactatgtcgcccaggctggagtgcagtggcatgatcttggctcactgcaacctctgcctcccggattcaagtgactctcctgcctcagcctcctgagcagctgggactacaggcacctgctaccacccgtagttaattttgttttgtatgtttagtagagatggggtttcaccatgttggccaggctggtctcaaactcctgacctcaagtgatctgcccacctcagcctcccaaaatgctgggattacaagcatgagccactgtacctggcctgggttaagtaatttttaaaattacttttacctatttctttttcttttttgaatgtggctgctagaaatatacatggcttgcattgtggatcatattatatatttttacctttttattgtggtaagatatgcataacatttaccatttggaccatttttaagggtccagaagttcagctgtgttaagtacattcccattgttgcgcaaccatcaccatcatctacccccagagcgttttcatcttcccaaactgacactctgcctctataaaacaacaactccgcttgctcctctcctcccagcccctggcagccactattctactttctgtctctgtgaactggactattctaggttgcctcatacgggagaaatcatatacaatttgtccttggttgctggcttatttcactcagtatagtgtcttcaaggttcacgcatgttgtagcatatgtcagaccttccttccttttttaagactgaataatgttccattgtaaggatataccacattttgtttatccattcattcactgatgggcatttcggttgtttccacttttggctatggtgaatagtgctgctgtgaacattttggtacaaatatctgtttgactcatattttcagttcttctgtgtctatcatattttattggacaggactatgccagtgatctccatagccacataatttgaaatatccctaaaccaggaactacccaaatgctcatcgacagcagaacggataaattgtggtatcttcatacaatgcaatactccagtgagaatgaaaatgaatgaacaactacacacagcagtgtagatggaacttgcacacatatgtgtcgagcaaaagaagccacacgcaaaataatacatattgtgtgattccactcacaaaaagttcacaagaggcaaaactaatttatgatgttaaagtcaggatgatggctgctctttgggggccatctgggggcttctctggggctgacaatgttctggacaccatcttcaggagcgtggtcactccgtgaaaattcatcaagctaagcacttgggatttgtgtgcaactttgtgtataagttagacttccataagaaattccaaaagatgctttgatccagcaattccactcttaggaattaaacgacagatatattttcatatgtgtgaaatgaggtgtgtacaagattatccactgccgtttttatcagcaaaagattggaaacatgccatctcacacctactaggatgactactatttttaaaaaatgaaaataagtgttggtgaggatgtgaagaaattggaaccattgtgccctgttggtaggaatgtaaaatggtataacagccacggaaaactgtacagcagttcctcgaaaaatgtaaaataaaattaccttatgatccagtcattctgcttgtgggtgtgtgcccaaaataactgaaaagcagggtcttgaacagatatgtgtacacccgtgatcatagcagcactattcacaatagtcaaaggtggaagcaatccaagtatccaacaatggacgaatgaataaacaaagtgtggtctatatgtaaatggaatattattcagccttaaggaggaaggaaattctgatagatgctacagcgtggatgacccttgaggacactatgctaaatgagatgagccagacaagaaggcacaaatactgtattattccacttagacaaagtatctgtctaaagtaggctggatgcggtggcttacgcctataatcccagcactttgagaggccaaggtgggcagaccacctgaggtcaggagtttgagaccagcctggccaacatggtgaaaccccatcttaactaaaaatacaaaagttagccaggcgtggtggtatgtgcttataatcccagctactggggaggctgaggcaggagaatcgcttgaacccgggaggcggaggttgcagtgagccgagatcgcgccactgcactccagcctaggcgacagagtgagatccgtctcaaaaaaaaaaaaaaaaaaagtagcccaattcatagggacagaaagtagaatggcaattccaggagctgggaggagggggaataggatgttagtgtttaatgggtacagagtttcagttttgcaaggtaacattttggagaggtttggtggtgatggttgcagaacaatgtgactatatttaatgccacaaaactgtacacttcaaatgattaattagctaatttttggtttttttttttttgagatgaagtctcgctgtgtcacccaggctggagtgtagtgacgtgatctcgactcactgcaagctccacctcctgggttcatgccattctcctgcctcggcctccctaatacctgggactacaggcacctgccacaacgcccagctaattttttgtatttttagtagagacggagtttcaccgtgttagccaggatggtctcgacctcctgacctcgtgatccacctgcctcggcctcccaaagtgctgggattacaggcgtgagccactgtgcccttcctaattagctaaattttatgttatgtatattttgctgcaattaaaatttttcaagtgaggtatctataaggaaaggtgagaaaatatgtaagatacaaagataataaaatccagagcaagaacagtatataagtcctgtttccttatgttgaaatatatcaaaatattcaacagaagaccccaggataggaaagatgtgaaattctagactggatcatcaggtccgacggatttacaaagaaggtggccgaggatctctctccccagccttcaccccctcactgactgtgggaaaataaagggcttggggtttggggaggaggtgttgcaggaggagcggcagctccagctatgagacctcacccagagggggccaatactgcccctccagatgccaggcaggggacatggaagggtttggggattcgttgtgggctggggtgggggtagcttgcaggggtctgcttgggtcttgttccctagggcctcctggagggtggagtggtcttagcagcaagaagctggagttggatgttggattcctgagggccgaggaaggacttgcaagggacctccagaaggagaagtgcatcccccccagggtcaagagtgagggagccctgcagcaatggccatctgtgggacatctgtgacactgtcagctggaagccagcaggatggcggcagctcaagtgagacccttcccctccccttactatctccacagcccccacttgtgggggaggggaggaggtccagagaaggagccccccaaactgcctccccaggacaggccccagctgggcaaggggagaaggtttaaacctagatccaattgggagtttggattaatagcttgactggacattttaaatttgagttgagaccatgtttgtgacttaaagtgatggtagaactgtcttatgtaagaattggggccaggcacactttgggagtccgagacaggtggatcacttgaggtcaggagttcgagaccagcctggccaacatggcaaaacctgcctctactaaaaatacaaaaattatccaggcatggtggtgtgtgcctgtagtcccagctacttgggaggctggggcagaagaatcgcttgaacctgggaggcagaggttgcaacgagcagaggttgccccactgtactccagcctggatgacaaagtgagtgagacttcgtctcaaaaaaaagagttggtcccattctccagtgggctagccttggcttgtctcatggtggaggaggctggcgggggtgggtcaggttcaggggggtgggggaaggtggggagcagagggtgggagagagagagagagagagactgcaaggactgcattctttttgaggctcaggctcagaactagcacaaggtcacttccaccacattcaatggaccaaagagagtcccaaagccaacccacattggagagaacgaaggcaaagtcacattgcaaaggggtgtggaaacagatagtggtgcagaatctggcccgctttcataatcagtccactggaagactttgttttcctcgcaaggaaggttggaaatgtagactcactgcttgtccaggcagaagaggaaatgagttcagggaagagcttgccagtccccagcctttgcccagccccctactcatgcacatttaggcacacacctactgtgtgctcagcccagcagggtagattagagagagcgagggcgtcgggatagagggcctgattccccaaccgggtgactatcacttccggtctcatgacctccatgttctcatctgtaaaatggggataaacatcctcatcatctctcctgccattggtatggtggtgacaaaaaacactttatcgattcatgaaagtcatcagacaaagtggatgatgctgtccctgccctcaaaggtgttaaataaagaagatgagaattcaatacatgtccccagctctggtgagactgtaggggttgtgttaacaagggagggagagacatcagagagctgttggcaggggagagccctgtggccaagccttgacagatggtgaacagaatctggaaagacagagggcatggggcatggcagggtgtggaaacagcacacttgcaaaagtgtggaggctggacacatgtgatataaggcagggtcccctaccccatgattcaaagcagaaattcgcaaagactttgatgtaggctgggctgggagttgactacacttgcatgcctgttgcttggcaggatggctttcaaaaaagaaaaaaatataataatgaaagattgaaaacagattattggggagaaaagtatcccaggcgctagacggctgtctctgcagcctctggctcctgtcccacccattccccggccctgacgcaaggctggctggaagaaggtgttctcgagattgttcaggctgagggcctgactggcaggagactgaagcctaccccattcctgcctgggtgccaagctctgcatgaggtttaaatatacccacagcctgacactatgccctagatcatgctaaatgtttccatactccttgaattctcttctcaaggttcatttattgtccccatttttcagatcagtaaactgaggcccagagaggttaactggtttgcccacagtcacacagccagacaagtttgagtatgtctgattctattgccttattccaggtttgggatacaggcagagtagggagaggtttaggatggtaaagaagaatgttccaggaggaacagagttagtgtaagggcagtctaatctagagtcagaatttggagctgtttgttacagcagcatgacctagcctatcctgactgatacaaatcatggtaaactaatttatatgtcctgaaaaatattagaacttagcatctacctcttaggagagcttttttttttttttttaacttttacattttggcaaaacacaccgaacataaaatttaccatctaagcaattttaaatgtacaatgcatggctttaagtacattcacattattgagtttctatcaccatccttccacagaactcgtcatcttgcaaaactgaaattctaaacccattaaggaaacttctcatttccccctccccagcccctggcaattccactttctgtctctatgaattggactacttttgacagatacctcctataaatggaatcacacagtatgcatctttctgtgactgatttatttcacttagcataatgtcctcaagcttcatccctgttgtagcatgtatcagaattgccttccttttttaaggctgaaaatcttccattgtgtggatacactatattttgcttatccactaatctatcaatggacacttgagtgcctttcaccttttggctattgtgaataatctgctatgaacatggacacacgaatatcagaggcagccttttcaagcaaagggtttttggggaaaaagccactgtccaggactctaggcttggccactaacttgctgtgtagctgtgggcacattgcttcctgcatcgtgtatggcaattctaactctctccaccttcactgcctactcacagccgtgtgctggggaccagattagaccatggactatgaaactctcagcaaagaaaaagccacgaggggctgttattgttattactcagtggggtcagggcagtggcttcccaaaggcatgagtcactcatggtggaattccagacatcaggagggccgttctgggcagcagagcccagattccagacagagcagtgaccctgacccggagcccctaggggagccacaccctttctctttggccactggctgctgtgaggaaggagtcagtgaatgtcataatcatatgggcacttagggtgagagcctccagtcccactgcctcacgtaactatttaaggaggctcagaaagggtcatgcacttgcccagagtcacacagctagacagtggtggaagctggcctgggtcagatttggacatctacagaagcccttctcctccctgctcgcacccctcttagccccagcatgtgaggaaggcagctgtctccctgagctccgtccttctatgccttgggtttagccatgttgactgctgtaacaaataactccaaaacctcagtggctttgcattataaatgcttggttctttctcacatcaaactgcaataagtcttgacaggagggctctgttttctgcaggtcatatagggattgagacttttcctatttgtggctttcctcattctcagagtcctctccattcagcaggcagatggcagaaagattgtgggtagaagatttttataagccagacctgaaatcagtacaattatttttgcttacatcccattggccagagctcagtcacatgaccacatctaactgcaaagaaggctgggaaatgtatcccacatgtgtgcccaggaagaagaagatggctattggtgagccttggtagtcttccacaagaacatgacccagttctggccaataaaacataaagaaagtatgctgggacaggaggtttgagaagggctggcctcaattattatataaaaaggggtgtggggaaggtcccctattctttccctttaagtggttgcatgaggatgcgatgtctggaactttggcagccatgttgagagcatgacgggccaagcctcagggctacagccaatatactgagggtgctgaagccaaaatgcgggtcctagatgacatcactgaacctctgaatgaaccaaaactggagccacgtaacctccagatttcttgactgcgaaggcacctattattgaattcaggagtaatagggtattctattacttgcagcctaaaacatcctagctgattgacactcaggtgcaaatgctgaaaacagctaagaggacaaggttaagccatgccagctgttacaacgaataactccaaaacctcagtggctttgcactacaaatacttggttcccttgaaacccctcctctgcttgaagttaggtagagccaagtaacatagctttggcctactctggatgttgtgcttttttggggaagttggggacagagcagcagttcaagcacaaaatgacctggctgctttgtgccaggtcctttatacacacagtgtatacacgggagcaaaatgcctggactcaaatcttgagtctgccacctcaccagccatgtgaccttgggcaaagtcaatcaacctcactgagccctagtttccccattgaaaacattggggtgattataaatattctacccacagagtaaaggattaaatgtccaattcagataaagaacttggcacattatctgtaaataaacacttaaaagattctgaccagagcctggtgggatgtgagtaatatcaaccccaccttagagatggggagtctagggttcaaggaaatgaagtccaaggacatataaataataagagacagagcctggattttaatacagacctaattgaacacctgctatgtgccaggcattgtgtgaggtgtttagatatattatcccattgaacatactagcaatcctgcatgggaggtattattattatcattattgttattcctattggacaaatgagaaagccaaaactcagagaagtgaaaagacttgcctacaggccaggtcaagatgcagtacttgaacctaggctgagtccaagcctttattctttccaccatgtataagcctccctaacagaagcccaccagactattatagtggaattgtaggcatcagaggagtaatacatttggctcccatggctattcagggttccctgaagtcatccccaaaagctggctgccagtccagcctgtcaccaaggttgtcctggtgatggctttaccctcactcctccagtagaataactgggccctggagtggatggtcctgagggaggaagtttggctcacttgataaagcagaactttcaaacactttgagctcatccatgatggaataggctgccttgggatgcgatgagttctgtggtcctgggaggatacaagcagagaaagtctggtggccacctgcaaggaagattattaagacagttactgcatagaaagtgaaattagattcaaagacctttcaggtttgaaatctgtggttgcaagattctcaggtcccattttctcagattccagtctaagattacatgatactcaaaatccaggaatctaaggctgcacgagttttctccttggattttttgttccctatttaggcagttagactgcagaacatctactgactcaggaaacagatgtgttagtaaaagcagagaatacatttctgggtttcaaaaacaccccttcctcccaggaaagaacattcctaagagacttgggcatcttgaacacctaatgaatctgaaagaggctctcactttctgtgactgtctttagggactgtccacaaatactctgtttcttttccttttagggtgccttagtctgttcaggctgctacagcaaaacatcttagactgggtaatttataaacaacagaaattcattgctcacagttctggaggttgggaaattcaagatcaaggctccagcagactcagtgtctggtgggagcctgtttcttatagatggtgacttctgtgtgtcctcacatggcagaagggacagatgggctccctcaagcctcttttacaagaacactaatcccattcatgggtggagccctcctgacctaatcaacttccaaaggccccacctcttaaggctatcactgtggggattaggtctcaacatctgaactttggggaacacattcagaccacagcacaggcccatagtaggatttccacttgaactccctcctctgcttgaagttaggtacagccaagtaacaagctttggccaatgaaatgtgtgcagaagtgaagtgtgccacttcctgggggagactttaggagccagtctgtggcttgatgctttctcttgccctctgctgtgcaacagttgaaatggtggttgttctatcagctgggatccaggagcaaggagacacagagcagcgcagcagctgcccagcaggggacgtgcatcaggagccactgagaaacaggacttgagcgttgctgttactgtagcagaactcaccctaccctgactgatgcacagctctcccctcccctccctccttcctcccatctaagaaggctgggaaggaggtcagagaaaaagctatgagtgagcatattttggattttgttggtcagtgggccccagagagctttgaagaattcagaagcagagagcagggaggatctcaagagataaaatggccaagagggccagagacaacctcacgcctagatacaattggggaaaaaaaatgaatggagctgggaaagtgatggggttggggaaaaaaatcccaattgaataagatgaattttctgcccacatatggaatggagcattgaaatgagaatgaatttaaaatagattacatttccagcccatctgaatttcagactgagaatatctgctgcacataattcaagatcccacagtctcaagaggcttgggtcctgggctttgacaatgactcttttcctgggcagaaggttgtacatggacactgggagcacctaggcctggaagctgggagaactaggctctcctgtctgatgtcactttccctgtcactttcccagggaggccttccctgactgcctgacttaaaaggaacttcctctaccaccctggccattctctattcctcttcttaacatcaattgacacaccacaagttttcattttttttttttttttttcttgagatggagtctcactctgtcacccaggctgcacccaggctggagtgcagtggcacgatctcagctcactgcaacctccacctcccaggttaaagcgattctcctgcctcagcctcccgaatagctgggactacaggcacgtgccaccacgtccagctatactgatgtgtttattgtctatttccccacttgactgtaagtttcaaaatggcagatattcctctctctctctctccctcttttttcttttcccttttatttataaaaaacttcaaacatacagaaaacctatcatgaagacccatttaccgcttacccatcatctagatttccaactgttaacattttactgtatttgcatcatgttttttggtgctggcattttctgaagtatataatattcttcactatatttccttttaaaaaattgaagatggccgggcgcggtgtctcacgcctataatcccagcactttgggaggcggaggtgggcggatcacgagatcaggagatcaagaccattctggctaacatggtgaaaccctgtc[133 bp omitted]cattccagcctgggcgacagagcgagactccatctcaaaaaaaaaaaaaaaaaatgaaggtaaggagttttgtctgttgtattcactgccatattactcactgcctggaagttggtaggccttcagcaaatagttgctgagtgagtagaaggcgttaaatcctcatgacaaccctgtgcggtaggtgttattatcccccattttacagaagaggaaactaaggcacagagaggaaaagtaacttccccaaggccacatggttggcaggtgatgaaagggggatttgagctcaggcaggctgagttcagagcccatgcatttagcgcacaattgctctctgcgggcaatggccattcatctccaactgggatgtttattcatcctctttagataccatctacagaggagacccagaggaagaagaggggctcacaggctggccaaaagcaggtgatcttcctctggggacctgatgctctcacaaagcctggggccttctgtcctgccctggggtggagacagaagactccttcccagacgagtgacctttagggtttgttatgaatagagattccttctggggaacgtgatggctgatgctgggaacccgggtccccagatttaacccctaggaatgtggagaggaatctccagacctccacccaggaggccagctctcccagccacccaggccagccagaagagggtggttctaagcagctcttccagttattggaccactgggaggtggactggaaccttccatgtccaggctgggaggcagctcctcagagtaaaaataactctaggcttcaaaatcctggggtctgcctcttcctccccagctatgtgacattcactggacaggtgcctcatgtggggggactttggttttcacatcaatctaatgggactaaatattataccaacctctcagcagggctgggactagggtgaagccagccaggtgctcaaggcataacatttagggaggtgcttgttctgaggcgccaaccctgcacttgctcaggccccggggtgagggcctcggtagatttgcaccctggtcaccttgctgcctcaacctggccccagccctgcctcccagggttgtcgtgggaaggaaatgagatattgtatacaaagcatgttagcacagcatgtagcatgcccttagtgctcacttgtggggaaaattctgttattgttctttttttttttttttttttttttttttttgagagagagtctcgctgtgtcacccaggctggagtgcagtagcacgatcttggctcactgcaacttctgccttccggattcaagtgattcccctgcctcagcctcctgagtagctggattgcaggtgtgcaccatcatgcctggctaattttttttttttttttgagacggagtctcgctctgtcgcccaggctggactgcagtggtgtgatctcggctcactgcaaactccgcctcccgggttcacgccattctcctgcctcagcctcctgagtagctgggactacaggtgcccaccaccacgcctggctaatttttttgtatttttagtagagacagggtttcaccgtgttagccaggatggtctcgatctcctgaccccgtgatccgcccgcctcggcctcctaaagtgctgggattacaggcgtgagccaccgcacctggccaatttttgtatttttagtagagacggggtttcgccatgttggccaggctgatctagaactcctaatttcaagtaatccacctgcctaggcctcccaaagtgctgggctaggattacaggcgtgaaccaccgcacccagcctgttcctattatttttattgactgcctttctgaggttggctgggcctgtttcccagcagtggccctgccttggacctcttgccatggccttcgtctctccctccacttgtacatattataccctttttattatttatccccttgtagcatggtttgattcccattatttactggttccttgtcccatgtctcctcctctgtgtcgacagcctggaaacaatgattgctaatatttaccaagtgctcaccatgtgccaagccctgggctaagcatttacatgctggatttcatctcatctttacaatgatcctatgaggtagggactatgattatacccatttttcaaatgaggaaatggaggcacttaaaaattgagtaacttgcccaaggatgcattgttagaaaaggatggagctgagggtagaatcaagatggcttaatccctaaaacccaagggatggaacccagaacactgcctcttccactcttcaccagcttctgccctgcagggtacacgcagatggctccaagcaggggccccattgctcactgggggaaactggcctccctgagctaagtcaggtcctgggcagagggacagatgctctctgtgcatctctaggccacagcagggcgtttccaagtccttcccagaccagacggcggcttctgctgtaggctatagtaataacaacagcgttgagcactcacactgtaccagagcaggggtggcgccgcgctgcacacctgccgcccagggtctccacagtcctcacgctgcccttgcattgattattgtctttatgtgaccagtgtggtagctcaggtgtcaagacctcaaggcacccagccagggtcgcatctcacgtctatggcagatccaagatctgaacttggacttgtctgaatcctggataagctggggggtgaagctggctgctgaggatcctgtgtgcccctcagccctgttcccaccacctctgtgcctcctccctgctggcagccactgtggccacaatggggttaaccccagaggaaggcattgaaggcgctggggctggggtgggaaggaaggcatatttcggggctccaaggacttgaagcctagctgctccatgcccaggctctgggaccccccaatacatgcacacattgtttaaaatgaagtggaactccaggcaggcaagttttgatttaggggagacagctcctccatggtaatgatactgagccttgttatttgagcaaataggttttctcccagcctctcactcctttctttgtaattcatcttccatcctggccacatgcaggccctgcttggaactctctggggactcctaccccacaggatagtctaaaaccctgccccggtattcaaggctgtttgcagatgttcctcaaccccaccacctgttgctcccaaaattcacacaccccagacctgcacaccacagttgttgctattccacacacaggtcgctgggagcagcgcacggcccagccccgcctttctgcaagtggatccctctgcctggaaagtcctccctcccctcctctggatcctcctgggtcaggctgggtgctcctctgaactcccaggctgagggttgctgtgtaatttgatactacattgacattgcaggaagatcatgtatggctgagtagctaaaaatgcaggctttgaacttggatgtgggttcagcctcagctgtatctcccgccagctgtgggacattgggctggcgtctctgagcctcagtttgcttctctgaacatagaatgatacgccctactccattaaggtgctgagggtgaaggaaaccacgggctcagtgtgggcagcttggccagggctccaagcgcatcgggtgttcatgtagtccttctagtgccaggcggtcattagcaacttggtgccagtctctgagctggtctccaggacggagcagtggagggaccatgtagcccctgctcccacaaacacagacattggacagccaattagttaccccagttcgttaccatggagactataattagggattatagtcaccctgcccaagcgcacaggcctcacctcccatccttgccttagctttgaagctccctggagcaggatctaaactggatttgtctctgtaacctcagttcctcattattcatggtcggaatgctcagcaaacgtttaagtggaagagatttccataacaaacacttgggagttcagaggagcacgcggtccaacctgaacagagcaggaggatctcagaggagggaggccactaggtaggatgcggcggcactaagggtagcacttagtttgtgacaaggactgttccaagcacaccacttggatcatctattaaattctcacttatttatttatttattttaaaattgtgtttatttatttatttatttatttatttatttgtttgttttgagatggagtctcgctttccaggctggagtacagt[136 bp omitted]catgttcaccaggctgatctcgaactcctgacctcaagtgatctgcccgccttggcctcccaaagtgctaggattacaggcttgagccactgcgcccagccagtgatcacttatttagatcacttactaaaatcatttaattatgtcaacacctctgtgaagtatgtactgttatcaccattcccatttcatagatggggaaactgaggcacagaaaagctaagtaaactgctcagagttacagagcctgcgagggccacagccagaattcaaacccaggccatctgcctccacagtccactttctatgtccctctcccgagatgatgtccctttcccaggggtgtctggaaagggtctggcccctggtcccagctcaagcagctgtccagggaagcctgaagacctggcccatctccactgcccaccgggcttctctgcgctccacttcccaggtggactgtggaggcaaataaggccccagctgcagcctctgaagactcctgccaagctggcactttgaggcctgggggtgtcccaggggatcccagcccagcagctgggctgacctcagggccagtgtttccgtaaacacccggagagccagccccacgtggttgatctgtgggttgctggccaagaggggctgaggtttggctgacctcgtgcggtttctttcaacaaggctacttccaccccctccgcctggctgggcttccagtaatgaagtgttttctctggggctaggggagctgatggggctggtggcgtggggcactggggtcttcctgtcccacgtgccctccaccctgggcttctggaagctggtctagatgcccctagctgccgcctgggcagcccatatgcccacgccggtccctgatagtgaactggcccgtaaggggaccaggtctcgggatctgagcatggagcaggggctgcgcccaggagatagggtgtggctagactttcccctgctggtcctttccggggatctgaggggaaacttctcctggggacacacccgggtagctcagagatggaagaaaaggtctccattacagctgccacctcttccccacccaaagagagtgtccgcagggggccgtggggcaggagtgagtactgaaggaatactaaccacgatcactgctaccatctcctgaatgtcactgccccagccctttaattctcacaacaaaccttggaaactgaggcttagagagaggaagtggctggcccaaggtcacatagtgagtaaatgagcagagcttctccccctttcccttgaatcacctctatcttcctgtccagatgccaggcagcaggaactagcaggtgcttttgggtcatcttttaagaggcaatatagcacaatgagtgagagcagggactcaagggccagccacctgggttcaaatcccagctctgcttcctactggctatgtgaccttgggcaagtcactcaacttcttggttcctcagtctccccacctgtataatgaggataataatgatgcctcctttagggggtttctgtgaggattgcatatacacgtgacacataataagccctgtgccatgctagttatcccagcctctcactcttcccattgaaaaggtgaagacacagacccagagatggaggcaaattctgcaggggtcatgcccggggcagagcatggttcagctatgtctcctatggtgctgccaaggagccaccatgggcttgagctgagaggagccacctggcaccggacacgtgacctcctcgagggaagggaggctctgcagagagcaggggatggtggaggagcctggctttatcttccatccttcaggagcggggaagggcagtgtcagagccaggagaggagagaagcgaatgaacgtgctgtgtgagctccagtcagtccctactgactctgggcctgtcactcctgctgagggactcgggtgtttggacttttagacttggaggggctcctcggtggggccttgggggctgctctgggtgagggctctcaccatttgcttcatcccaaaccactgtccttgggcctgttttaaatattagagtgtagcatggggttttgctgctctaacaaagggtcagccatcttgagaaggaggctctgtgatgagcagggaatggggctcccctgcccccccgagaccctggggcccaagctgatgactggccagtgactcactcccttctcagcatgtcctgtcatcccatgactgggagcccctcgggggtggctcctaaccaaggtccccctgaccaaggcctccccccaccctccccctaacacacatagagactgggaacaattaactccctcctaaggccagaccagatgttcacgtgggcattggttttgttgaccacatgtgactcaggagctccctcagagctggaagagtcccaagaggctaaaagggcaacctgtcacgtcacagctgggaaactgagtcccagagaagccaggtgagttgcctaacatccctcaggggtagaagggaggaaggaacctggagttcccatgcctgacccagaggctttctacctctccaaatagttctcggatgtgcccaaggcctcagtccccattcctacctccagttgcaaatgtcctccccaactacacagagcctctcagcttcatcccaccccacctccaactggctctcatggtttcatccaggctcagctacttgcagctccccaaatagctcctgctgtcaggccacctccaggcctttgtactctcctgctgctctgttttattttcctcttcacctggacaactcctaatcttgctccaagactcatctcaggtgtcaccttctccaggaagcctttcaaaaccacctcctccacctcccaggctgggttaggtcctccatctcttcaccctcagtacctagtatctcccacttactgtgctggaatcatctctttgcttgtctctatattgccctctagtctgtgagctcattgtggacagagaccttagtttttattcttaatagtagggaatgacctattacattcggtgtttgctgaatgaatgcataagtggatggatggatgaatgaatgaatggttggatggaagaatagatacatggatggatggattgatggatggatggaatgagtgaccaaatggtagatgaatggacaaatggaccgacaaacatggaaggatggatggatggacagatggattgatggacaggtggattgatggacaggtgggtcgatgggcaggtggatgaataaatcaggcagataatggcatctgtagggactcagacagtgagggctaagtccctggagcctggatatcctgactgatgaaggtgctcttggatgggaagggaataacctaacctgttgtcttcctactccaagagatatttggtccagaacaaagccacccctgccctggtgcctgctcccttctgaccaacaggttccaactcagtggggtctcctgaactctggtaactcatctgacaccagagcctataggaatcaccctgtctctgacattcagggattctgcattcctgaggccctccctccctgcctctcttcaggtcagagctgccgccccataaatgctttcaagcatagaaacatacacccctagagccaggaagttgtaaaaatgatgggattcacccctctaccatttttgcagatgaagaaactgaggctgagcaaggccaagaaacttgcttaaggacacacagcaatagagctgggataagagcttgggtctttcaattcgtttattcgttcatacagcaagtatgtatctagcgcctaaagtgccaggctcagtgcctattcccgggcatgctaggcctgtgcataagctttcatgttaatttaaaagctatttccatcctccatatgacctcctccagctccccagcaggctggtctatgcctcactagctgcatgcctggcatgatccctatgacaacaccctctcccagcaaatgaggaccacttcattgtcaggaagcctggctgggactggtgtgtgctgccgtgtgcagaggaggcagtcacatgtgtgtgctgtgagctgcacattccatcctagccttagtgaggaccgtattagtccctgcacgctcatccttgccagctcagactggagccaagcattaaactgttcaagccccacagctgccccaggcgagccattgcatggcacctgggagctcagggccaggagcagacctctgaattcctgcccaaaccagggaatatgtggtgagaggaggtcatagggaggtgcctgggggctggacatttgcaagccagctgagcaggcagtactcagcactttcctcttcacccctcccaccatggcaaaggcaggggcagcgtgggctagccagccttggagagatggagcctcaagtctaggggcagcagcccagcctcgggcgagccagggctatttgctgggccttctatgaggcttccatgaagtatgtaacctcgccgaagacatggaactactcagagtcattaagagccaaagaaaggctcagctgcgtttaacagaaaagcttctgggaacaaatcaatgaattggagaacaaaggaagactgcagaagacgaacagaaccagaagccatgtctaggatgaaatcaacatgaggtagagaatcctgatgacattgatcaggatgaaagaagtatgaggcaagggagtaaaatcaaatgccgagtaaaaagggggaacaacgttgaccaaggaatttgaagttaatttaagagctgttatgaacaatacaaaaaagaaaattataggcccatttcacttatgaatatatagatagaaaaacactaaacaaaatatttgctgactgaattcagcagagttaaaataatgacaccacatcaccatcaggaagcgtttatcccggaaaaacattccagaaaatccaccagtgtaattcactacatcattagatccaaaggaaaatctatgatgtcaattgatgtggaaaaattttttgataagttccttttgtatttatgatgcttacaaatttgaaaattctgggaaaatggagaaattaatagaaaggtataaaatgtcaaaagatgggcccaagaagaaatagagaatttcagtaggtcaatcagtattacagaaactgtaatggtgtcaaagccctcccactcccctaaaaatcagcctagatgttctcatgggtaagtactgctgaacctttttttttttttttttttttttgagacaaggtctcattctgtcgcccaggctagggtgtagtggcccaatcctggctcactgcaacctctgcttcccaaggctcaggtatcctcctgcctcagcccctcacgtagctggaactacaggcatgcaccaccacacccagctaatttttgtatttttagtagagatggggttttgctatgttgcccaggctggtcttaaactcctggactcaaacgatccacctatctaggcctcccaaagtgctgggattacaggtgtgagccaccgcgcccagcctgcagaaactttttagaaacaattaattcgtatcatatgcaagttgcttaaaaagaaaacaaaagaaaaaaaaaccaacctatcttattttaaaagtgttgtcttgattataaaagccagataagacaataccacaaaggaaagtataggtccatttcacttatgaatatggataggaaaacactaaacaaaatctttcctgactgagtctagcagagttaaaataatgatactacatcaccatcaggaagggtttatcccagaaaagtatccacatctgaaaatccaccagtgtaactcactacatcattcaatcaaaaggaaaaatccaacgatgtcagctgatgcagaaaaaggttttgataaggtctttatgtatttatgatttttaaaaattcttagcaaactaggagcatgagagaagttccttaatttagtagggatttttaataccaaaaacctacagaaaatattgctagtggagaaaagttttatataatacatgccttttaaggtgaggaacaaggcaagaatgctagttattactgctactgtttaatacatagagctggagagctgggctgagctacaaggaaagaaaataagaggtgtaattattggaagggaagagataaaactgtcattgtttgtagatggtgtgatcatctaccttgaaaaaccaaccaaataaactgacaaaatattagaacaaataagagagttcagcaaggttgccagatacacagtcagcaacaaaaatcaatgacgcttttacatcagcaataactaaccagaaaaacacaacataattttgacttaaatagaaaggttttaaaataatatatacatataaatatattatatataaaatgcatatacatatatatatacacacatgcacacattttaaaagcacagctggctatggtggctcacgcctgtaatcccagcactttgggaggccgaggtgggaggactgcttaagctcaggagttcaagaccagcctgggcaacatattgccaaaattttttaaaaaaacatttagccgggcatggtggcacacacctgtagtcccagctactaagggggctaaggtgggagaactgcttgattccaggaggtggaggctgcagtgagccgtaattgcgccactgcactcgagcctaggcaacagagcgagattctgtctcaaaataaataaataaataaaggtatatatatacataagtataaaaatagcgtatatatataaaacattatatctctctctacacaccacacacacacacacacacacacacacacacacattattatgtttctaatcacatgaatgaaatctacatgtagggtgcatttggcagctctgggtgtcatcagggatctgagttcctttatttctccttcgccctcttctgcacacgaagtccatcctcagggtaccctcatggtccaagatggctgcagaactccaccatcacgtccgtattactgactggaagcaggaggcagcaatcagtggtggtggagtcaccaaagggaagcccttccttttaaggagcctttccagaatcggcacacaacactcctgcttgtatctccgtgctggaacctatcccgtggccccgcctcctgcaaagctgagtgcgtcgccaccccaaacaaaaaaatcagtgtttggtgactgagggaggagggaagaaggatattggaatgggcattgatcaggctctgtcacagatctcagtctccaaaacacgaaactggggcactgaggtccagagaagtgagggaatttacacacagccacaaagcaaattagcagcggagttgggattttcacctgactgttgaccttcccatggtacaggtgtcccctcacaccctggtacatccagccactacagcactgcccctcctcacttccagccctgctggggtcaggatctgttttgtatttctctgtccccactacctaatgtcacacctgtgagctccacctccccagcgtcggcttgggacttggcatggggtagaggccgtaagcgggaaagcgggcacacacctcgggagctgacaaactgcaaagggctttcaaccgcagatatttacttgtggcttccatatgctgtaccttgatggtgatgtttcgtaagtttcacttttcagatgcattttttttttttttttttttttgagatggagtctcactctgtggcccaggctggagtacagtggcgcgatctgggctcaccgcatcctccgcctcccggtttcaagcaattctcctgcctcagcctcctgagtagctgagattacagatacgggccaccacgcccagctaatttttgtatttttagtagagacaaggttttgccatgttgtccaggctggtcacgaactcctgacctcaagtgatctgcctgcctcggcctcccaaagtgctgggatgacaggcgtgagccaccgcgcacggccagatgcatttcttagacgctaaaaatgttcagcctggcccaggcctggaagaacatgcaggccgcttttatttttatttttttttaacagatggagaaactgagacccagagaagcaaaagtgtgtgtcccagatgccaaggtacctgcggcaaagaatattacctagatgtccctcactctggttctccttcattgatacacatggaatgatggtatttccccgccttccttgcagttaagttggggccatgtggctagctctgactaataagatgtgagtagaagtgatgatgtggcttctccatccctcttttttcctgccaaggtgaccttggaggccaccggtctagaacagggattcacaaactgtaatgtgcatgcaaatcacctgggggtcttactaaaatgcagatcctgatagtggggtctgggagtctgcatttccaacatgcaaccagctgatgctgatgccatcggtccttggaccacacacttgagtagggaggagctacaggatgtgcctggcccactttggaccattcacgagcaagaaattagcttcactgggttaagccactgagatgtgggcattagtttgtgatctcagcacagtcttacggaaattgtcatttagccatcaaccaacattgactgagttcctaccatgaactcctgtgtgacctgggtgcctcattctgaatgaggtgctcactcttggggttgtgcaagtgcaaggtcagcagctgagaatgagagcctccctaaatgttatacccgacatgcctctgtcacctcaccctggtcccagccctgtaagtcggtagcgggagccgggatttgaagctcggacctgttgacttctgagcttgtgcttcctcctgggaaagcaaaggacagccacactcaccctgggcccttgtgtgggggctgcggctgcagccaaaagactcatgggttccctggatgcttatatccctctggtgccaaaattggacagtttgaagggagggctgaaccgcagcaaaccaatcagcaaagtggcagctcccaccgctcctgccacacccactcatgctgaactgtgtgtgcaagctccatccctcacacttcatcaccaaacacccttgatgatgacgcctgcttcctgatctggccaggccccagggcccctactgcccacactttcccatcctcagttatcagacagaaaaagttccaagaaaaatccatgctctgactcagagggccctaggtgggcatagcactctgcctcgttcttgccacctccctgccccgtatggccctgtcttcttcaccatacgtggcacccatggcccacctcacctcctcattgtcaaggtctccttgctctgctatggacatggctgggaccagcgtgtctccctccaactctcttcctcacacctcctcatttctcccgtcttccttcttgcctcagagatagaagtggcttaaaactgttcctttcaggaacaactaatcagtggccacagaggtcagaatagcgggtacctggaggacagagggtagagtcttggaaggggcataaggaaacttctggaagtgtagcttgacctgggtgattatcacatgggtatatacagtcatgtatatacatatgtcaagagtcaaaattagccaaacatgctgcctcatgccaccagctactcagaaggttgaagagggaggatcccttgaacccaggaggctgaggctgcagtgagccatgttcatgccattgcactctagcctgggagacagagtgagactctgtctcaaaaaaaagaaagaaagaaaggaaagaaagaaagaaagaaagaaagaaagaaagaaagaaagaaagaaagaaagaaagaaagaaagaaagagttgtcaagctctacacttcatattagtgcactttaagcacttttctgtatatacattacctctcaacttaaaaaacattatcacagagagctctatggacagtagcagaaataaacagcatcaaaaactgaaacttgggtgttggagtcatatgaacccgcactgaaaacctggctctgttttctagctgtgtagctttaggcaagttacttaacctttctgaacctcacttttttcaattgagatgtggatcatgaggattagaaatgctgctttttataaacagtgcttagcacaagggctggatcttgctgggtgctatacacaattgcttttatttttattaatatcagtggcctagggaggacaggaaagtcggagtgacctttcctggatgcaggcaataacgggtggggggcctacagaatttaaagataaaataaaactgatgagaagtcagtctgcttttatgatcactgtgcaatggcagatctaaataatttcagtggtaaaatactttgtcctgaaaataccctttattgatctaagttctaacaattggtgcagtaactgttggggtttaataatgtatatgtaaagcttcaaatcagcacatttttattcttatcctttaataaacatattctacatggaagtcaacttgacttggagaactttaagaatcctatagttgcccccagagcatgtggtctcaggaacacacatcagttgagagtaagctcctcacaactctggaatcttccaagcttgctttgaatgcattcctgtctccaccgtccagcattcatatttctgcatttatttttattattattttgtgtgtgtgacagagtctctctctgtcgcccaggctggagtgcagcggcaagatgtcggttcactgccacctccacctcccgggttcaagcaattctcctgcctcagcctcctgagtacttgggactataggtgtgcacccaccacgtccggctaatttttgtatttttttttttagtagggacgggtttcaccatgttggccaggctggccttgaactcctgatctcaggtggttctcccactttggcctcccaaattacagacgtgagccaccggcccagctgtatttctgtgtttaaacagtagagtgaaatcaactatgaacgcagaatgatgggaaagatgacgataagggtatttcaattttgtcattttacgaaactacttggagttttgatttgtatttacagtttttaaaagagtaaaacagtgtgaactgtgaatggtaatgattttgtttggtaagtgcaaattttaattcatacatgaaaaatatttgttttgtttcatgattattactgaaaataattttgtactatgaaggaagaggggtgttaaaaatgatccactgtggatgtaaattattctaggcatgcttctgactaaaacattagcatttccacaagaatcccaaaaaataaaacaaaatttaaaagatcccttctgtttcttttcctccaagtttccagacccccatctccaccctggccacctcttcctgccataaataatcaaatcccacactttcatcttcaccttccgtttccattgcctcttccgatgggacagcacccgtggggaatctcctccatgctcacaatccccgtcttgccactatatcaagtcacacttcttcctcaccaatcgcccattctggaacctctgctatccagctagatcactttgaggtttggacaactactggtggaggtaatgggggccccagacagcccttgacatcacctcttttatctttgccaaattctacaaacaaagcccatgtctttctgtcccccgcccccatggctggcacatagtagatgtccccaaatcttggtgatgtgaacttgtgtgtctcacccttcacagacatcaccatttcccgttgcacagaaggctccactcataccaggcgctttggctcccagaataagcaggctatcatgctatgtccgacatctaggcgttggtacgtactgttcccttggcctggaacattctgccctctctcaccctctcttttcttggctttctgaaatggcacctccatcagaaagtgtccctcactcttggtctgagcaagggaccttgcctggtattcctgaacttccacctgttttccctctgttttctccctctctgggccttgtcctcaggtcagtgttgtgcctccagctcctgcagaggcgaactcagaggcggccgaatgaaaccaaatggatttggcttgaccccatcatctagcggtgcccagcaagcgctggcacatagtaggtccagcctgcccggactcgcccaccacgggcccccttccagagccgggaggcaggccaagggaggccccttattgccaagagcaaacaggccgcccagggaagttttgctctgggtcacacccacctctgggtggctgccaatctgcctgccagaaaccgcaggctgggccgcggctacccagagtcagggccacggagcttaggagaccttgggtcagctctgcaaaggggttgtttactgaatgcttctggtatctgcagccccgctggggttcggacagggggtctggaatagggcttcacaactacagcagggctaggaccctcttgggctggaaggagctggagaggcctctgcaagctgtcacaggctcttggtgctggcactggctcaggctttcacacacacacacgcgcacacacacacacacacacacacggacaggcacccccttggtggccttcacagtttcaccttcaggtaaatgggctcatcctttgagccatgaggatgggaagcgaagcaaggaatgaaaaagctagtgtgtttgtgtgtgtgtgtgtgtgtgtgtgtgtgtgtgagcgcgcgcgcgcgcgcgcgtgtgtactcgtgcgtgtgcctgtgtgtgcctgggagtgacctcacagctgccggaacataaagactcacaggtccgcctcccaggctcaaagctggctctgcaggggacatgagaggcacaccgaagacccacctcctggccttctccctcctctgcctcctctcaaaggtaaggaggcccgggccctggaatgcactgctgactatttgggtgtggagggggtggggatgtaaaatcgcagccaaggacccccttggcagaattcctccagggccccacattgggcacagtctggcccccatgcctaagcagggcttctctccctggaactcagagctgcctccggccagccctgctgtgtgacctcagatatgtgtcttgccttctctgggcctcagcatcttcccaggtgaagggtatacagtttgtgaggcctctgtgaagaccattcatgatcattcatcaaacttaccaggcaaattgaagaggactttaatgtatcctcattatgaatgggggcactcaagacatgacatgcttggcctaactctgagccagcatttggatggatgcctagctgattggaaggttcattctgcaagggcatcaatgctgttggactcttaggcagtgagtgacccgcccgccctagctagaggggaacaggagacacctctgtggagtaatggccttatccctgaatgctgcatgggacattcaccaaagagcctgtgggacatctaccttgtctaacatgcacaacaatcccataaggaattttcagttaagtgaggctcagaaagggtaagcaacttgcaaccccagttttcagtcaagtgaggctcagaaagggtaagcaacttgcccaaagccacacagcaaagaaaggtcagagcaatagaggagagccatggtggagcccagaatgacatggatgtagggggagaagcactccagtctgtgcctccccaagcccaaactggaccaaggccacagctgctaagccttgtcatcccctcggcaaatgctgagttcccagagccatggaatcggccccaccacaagccacgatctcactgtattttcacgctcctttgaggagcacgggcaggagcttctctccctcaggctccaagtcttcgtgcctgggaagcctgagaaccacgctggcatcctgtcctgctgtttgttcttccaaaggggatgggtagggcatgatgccagtgtgggtggcttgggtagttggaataggggacttggggctctaggagggagaaggggcccaggattatacgagaacaaagtaaagctgtcctagacttgccattagggtgagacttacgggaccattcttccctggtcccaggaagcagggactgcacagaaacacagggacttagtcaccacaacatggaaagccacagcaaccctcagagggagaactgtaagtcttccaggctggccgttggctccggggctcctggctgtggaccggggcaggaggcagacacctggacacaagcaaaatcacattgatcaaggactggccagaacctcatttaatctccatcatcactcagaaacaggttgtctctactccagtttacagaggagaaaactgagcttcacctccaccttccaaagccgtttgtccacatgttcagtcacgtagcaagtcactggcagaacttgaatctcaactcttgcccaaaaaactccatgcccagtactcctgccccagatatcatgagccttgccccccaccaccagatatcacagcaaggccctggggaaactgaggcacaatgggacaacttgagtttgggccttggatgtcaacttgaacttggatgtcaatcctgattctgtctcttactggctgtgttactacacggtttgagctccagttttctcatctttaaaatgggcataatgatggcacctcacattggaggggtaaatgagacaacagcacttggcacatgacatacatatggtatcacatgagataattgtacactagaatagttgatatcattaatagcctctcctgggtatcggggcctacagagtcctgccccctgacaagcatggccagtagaggggtccacagtgggagccaaggtgcacagctgctggtctatttcctggcactcctgttttcaggtgggagggacctgagagtcatttctgacagtcctccctccattgcccacaagccaagggagctgaacctctgacttagaagggaacccaaaagcctagaccgtttctatgtgaatcacctgtggatttatgaaaatgcagattcgggctgggcgtggtggctcatgcctgtaatcccagcactttgggaggccgaggtgggtggatcatgaggtcaggagtttgagaccagcctggccagcatggtgaaaccccgtctctactaaaaatacaaaaaattagctgggcatggtggcatgcacctgtaatcctagctacttgggaggctgaggcctcccaagaattgcttgaacctgggaggcgaaggttgcagtgagtcgagatcgtgccactgcactccagcctaggtgacagagcaagactccatctcaaaaaagaaaaaaaaaaaaaagaaagaaaaagaaaagaaaatgcagattcggatttattatataaaaattcagcttcggatttatagaggggctccagatgctgcctctctgacaagctcctagatgacgctgctgctgctagttcagaccacaccttgaggggcgaggctaggccatcgtctctagaatctgaacagcctgcagcgatgggatccactcccttgtgaggcagccagacacctagctccgtgtgtccatctgctactcagtgctgtctcagtgggggctgtgatcgcctcctactttgtggcccccaccagaggctggtcagccagtttgcaatggctcctagtggccggcgtgggagttgccgggaactgaaagcaggtttgcaggattgtgggtagtgggggcactgggcggggcagagggtgaggcagagcaaaggggtcattgcctgctttggggctgcacaggagatatgaggtcattaattccatcattataaactgcaagcctccattcctctagatgaaaccctcatcccctaaggatcctactaaactcaaacttggccccccaaagatggggccactggaagcatcttgaattatacttccttcttggtccccaccttcaaatgggcagacagggagctcacggcacctgctgtatgctttggttgtttctctgatgtgggtggcgagggtcaggcaggccacatgggctgataccctgatcctgtctctggggagtgggtccctggcttacggacacagtctacccccatcccgtgtccctgagtcctcacttgggaagcaggaccggggacgctcccagccctgaatcgaacacactgacgtgtgctaagttcctgtccctctctggagctcagtttccccatccgtacctggcagggggaggaggttagactggggcagaggtgctgaaaacctagctgagcttcagaagccactggacagcttattaaaaataaagattccaggtccctgactctgggacttctgattttgtaagccccagagtgggttgggggtctgtattttcccaagtctcctggctgatgtgatgtacctccagagctgggacacatgctgaatggatcgaaaggccaaaaacatccatgatatggttcaatttattcagtcctaagataagtatccgtatgctggaaaatgtaccagaccctaccattttcatccttgacttgttgcttttgcctttctgtaagctcccagagggctggggctgagccctctgccaccattaacaacaaggatcatcaaagctaagtgcagtgagcgcctactgcatgccaggccctgtgctgagggtttgctgtgcagcatttcatgtactcctcagagcaatcctctgagttagatactttgaggaaactgaggctcagaatgcttaagtaacttcctcaaggtcactcagctaataaggggcagaattagaactggaagtctagccaggtgcagtggctcatgcctataatcccagcactttgggaggccgaggcgggcggattgcctgagctcaggatttcaagaccagcctgggtaacatggtgaaaccccatctctattaaaaatacaaaaattgccaggcatggtggtgggcgcctgtagtcccagctactcgggaggctgaggcacgagagtcgcttgaacccaggaggtggaggttgaagtgaggctgggatcgcgccactgcactccagcctgggcaacagagccagactctgactccaaaaataaaaataaaaaataaagaactggaactctagtccagagtccttgcccataactacatgccatactgcctcttagggcatgttgtgggactactggcctttgaggccaggtctgcatggctctgaggctaaggtgtggacaccacactacccagcctggcagagaagtggctggttgtgagggtctcactgcccacctcgaaagcccgtggctgagtgaggtctctgtctcttcaggtgcgtacccagctgtgcccgacaccatgtacctgcccctggccacctccccgatgcccgctgggagtacccctggtgctggatggctgtggctgctgccgggtatgtgcacggcggctgggggagccctgcgaccaactccacgtctgcgacgccagccagggcctggtctgccagcccggggcaggacccggtggccggggggccctgtgcctctgtaagcaggtttgcaggactgagtgggggcgggtgtgagcgggaggtcaaggccgtggtgtcctggatcaaagtgcagccctcctctctctacctccttgggtgctcacttcaggtatcccatccattccagctgaacttggtgtcccaaagcccactccccactccctcctctcccttcttggcctctgcttaaaccatctcactaccccaataacctttccccatccctacctgtccaaatcattgccaactttcaaagccaagttcaaacagcttctcccctgagaagcccccccagattcttcaaaccagatgccaccactcccttctcaggatccttacaacactttggggaaaataaaagtgcaaccttttagggcataatatgtgtccagaactgtgctaagcacttactacacaagtcacatcatcctcacaataaccctatgatgggaagtactttcagacctattttatgaatgaggaaacaggttcaccagcattaagggacatgcttcatgtcacacggcacgggaccagatccaacgggctctaaggaacagtttattctgtcttctcccatagtgggggccctcggagcactgctgggatcctgggtttgccatgtattcagcagtcacccgagcatgtgacattcctcaccactcttctaggccttggtattctctgatgcttcggggcagggctttgcaagctggctccagtgactgggtgccagagaattagttgttgtgggagggctgtcctgtgcatggtaagacttctagcagcatccccgaactccacccactgtatgccagcagcactccccatcccccaagtcatgacagtctgtcttcagacagtgccaaatttccccagggggcaaaatctccagttgggaaccatcactttagagaaatgcaaagaggcaagagattgttcttcttttttcttttttaataataagccttgtagaacaatttgcctctttcatctatgtgcatgtcacacttttataaaaataagaacgaaagagagagagagagaagctcatgaatcattgataatgaattcatctgtaggaaaagccttgttaaaaaacaacaggccaggcacagtgactcatgcctataatcctatcagtttgggagactgaggcgggacgaccacttgagcccaggagttctagtccagccttggcaacatagtaagatcctctctctatcaaaaaaaaaaaaaaaaaattagccgggtgtggtggcacatgcctgtggtcccagctacttgagaggctgaggtgagaggctcgcttgagcctgggtgtttgaggctgcagtgagccatggttgcgccactacattccagcccgggcaacagaccaaaccctatctccaaaaaaaaaaaaaaaaaaaaaaaaaagtaataactccatgtgaaatgctttatttacaagtactgtaaggataaggagggtgattcgttacactgactgagggatgattgcttatgaaaatgtatctgaagaacaattgagataagtaacacttcgcttacaaagctgttatttacatttgctgtgacacgtgtaaacagcacccacagagtttattttacacttgcacagcccttaccacgtgtaagacactgagggtttcacaaatataaactcatttaatctcacaaccacatgaggtaggtacccttctcttataaatggaaaaaaggggtacagagaggctaagcaacttgcccaaggtcacacagctcataagcggcagagctgagatttgaactcagggagctggctccacaagctccattgctcaactgcctgacatgcagcagttgattagtacataggctgtgattgttaataactgtattaagggatttttcttattccatcttaattcagacttcaaacacctgcaggccaaaggcgtacttgggtccctggtccttcctgcaacttcccaccttggtctgtcaacatgatgggtgctcaacagtgtttaatgatttaaactgaatttagaggccgggaactggtgaaccccaaagagtccagctaagacatcacaaaggctcagtctagggctttgcagggaacatactgccaaaaacctctcccatcacttactcgttgaacgctcttctctaagggccaactctgagctgtgagatgtgctgcagattcaccatcgtgataacagcgcatccaatgccgggatcctgatcttccgccccccagaacggcctccccagtctgttgagagcacctccatccttctcatggctcagactcaagacctgggagtcgttctagaggtctctctatctctctctcttttttttttttttttttttgagatggagtctcactctttcacccaggctggtgtgcagtggc[131 bp omitted]gacggggtttcaccatgttggccaggctggtctggaactcctgacctcaagtgatccacccgcctcggcctccctaagtgctgggattataggtatgagccaccacagccggtctagacatctctcttttctcacctcccacataccacccaccagcaaattcatcgtgtatttccagcatccgacactcccatcccttctggtctgagccccgtcatcattggcctggattttgcagtagccccataatcatctccctccttctgtcgttgcccctggtctattcacaacacagcagtcagagagctcctgggaagtcataagccagatcacctccctcctctgccccaagccttctggtggcttcccatctcagaggaaaagccaaagtccccacagtggcctacaaggccccaacaggatcctgttcatgcttcctctctgacctcctctcctcctgctctctgctccagccacattggccccttgctgttccttaaataccccaggcacactcgtgcctcagggcctttgcactggctgttccctctaccagcattatttctcagcaaggccttccctgctggaggattagatgagctaggggacttacagcattttgccccaagcctggcacatagcagatgctacgtggaagcataaccctctcctgtttattgagcatctgctatgtgccaggcttggggcaaaatgctgtaagtcccctagctcatctaatcccccagcagccctgtgagccgggtaccaaggctcagagaggcaaaataacttgccccaggccccacaagtgggagccagagttggaacctaagtatgtgtggttttggttctgaaacccctgtgtgtgtacagacctactggaaggttttctcagaagatctgggagaacttgtttgctaatgagtcctttccccagacgtagctcagtggccacccaggtctcacacacacgctgtttcccgtctgcacttcctgagcagctcacacgcttcaccagcgctcttacttcattctgtcttggagatgatgccctcacacccgtccccctttcccaagcccatgagtccctcaaggcaggaactgtcctctttctgtctgggagcacagtggttggcacacaggcgggaaacagtaaatatctctggaatgataaggagtagggctattttatcagggtctctcatgtgccaaggcttatgccagctattcactgaaggggcattcctacagtactgtgtgtcgcacctaggctctgagcccaccggagggtgcagagacgcacactggccgccccagccctcaaggagttcatgtccagtggaggaagtggcaataacacccatatcttgagggcttcattgaaagagtgttccctgagcacctaggccatgcctagcactgtgtgctagagggtacggacatgtcatcccatggaacctgaagttacgattactgagctcatcattgctgtagttcaggccactcagagaagttaagtaacttactcaaagacacacagccagcaagttaagccctgacctgacagtgatgacagcacaagtggacaacgactttgttgcatgaaatctcagcgtgtatagaatacttaaactttattaatatatagtaactatactaatgataataacagagtagctaggacctatggaaggtctcttttatgttgtgatcattacgcctatcattccgagtagtctctaccaccctggaaaataagtaccattatatcccagcttgcaaatgtggaaactgaggcaagaagaagtgaaatcacttggcccaggttcacagctaagaaagggcagagtttggggggtcaatccaggcctgtcttcttgcaatccctgtgccgggatccagggtgccccagcaggctggtggagggctggggagaggtgcatatcctgggctggagccctgggcagggcccagctactgtgaggcagctgcctcaggcagcgggatctgggcagctctgcagagaaggctgtgccgctttgcgggtcaccgatgggggtgcggtttttcctccgcagtggcagaggacgacagcagctgtgaggtgaacggccgcctgtatcgggaaggggagaccttccagccccactgcagcatccgctgccgctgcgaggacggcggcttcacctgcgtgccgctgtgcagcgaggatgtgcggctgcccagctgggactgcccccaccccaggagggtcgaggtcctgggcaagtgctgccctgagtgggtgtgcggccaaggagggggactggggacccagccccttccagcccaaggtgagcgcagcggtggtccaggtcagggcaggactgcctgggggcgccaagggccacctagggggtggggtggggggcggcttcctgggtaccaggacccagggacacatcagaagctgggaggggcggaggctgaggagggagataagaaagaggagtggagggccgggcgctgtggttcacccttgtaatcccagtacgttgggaggccaagacgggcggatcacctgaggttaggaattcgaaaccagcctggctgacataggaaaaccccgt[133 bp omitted]cactccagcctggccgacaagcacgaaacttcatctcaaaaagaggaaaaaagaaagaggagtggagggtcaccaggcctccctctttaaaaccaataaacaaaaagccactgcctttgagatgtgtaatttaaaaccataaataattaaaaataaaaactgggtgacagagccgggagaggaaaggtgggttagggtatgtgaaccaaattctcacatttcagagatataatagagctaagctcttagaatatataatattatcgtatttataatatattgatacatattaatatatttagtaatttattattatttgggcttactaaaaaaggaactcaaaactgaacgaggcaaagtggctgctctggaatgtgggccgggggtgggctagagatggagaaaagacagttacctcccaccgtcccactataaatcttcaattttagagatttttgttgttgctgtgttgctttttgaaaattatcacatgaatgtgactttctaaaaaaggcaactgaaaagaggaggattgatttcataaatgctgctgccacccacaagaggtagtcacgtgttatgggtcaggtgcacggcatctgcaacagccccgccatcccctttttgctgtgtgactctgagaaagttgcttaacttctctgtgtctcagtttctccagctgtaaaatggggacaataagagcatccacttcatagcgttgtgagaactacttgagtttgttcaagttaagcagctgtagcagtgcctggcacatggtactatatcagaggtagccgttattatccctgtgatggaatatgatatatccatttaaatacataggaaaacaccagtgagttcaccttatggataaaagcaggataagaaggtgtatttccaactcgatctcaactaagtgtgtccctatgcacgtatacaggtatatctacacatacacatgcatacacagcacacacatgtgggtagaaatcagggtttctcaacgtcagcactagtgacaattggggcaagtaattatttgttgggggggttttcctgtgcactgcagggtgcttagcagcattcctgacttctactcactagataccagtagcatccccccagttgtgatcaccaaaactgtctccagatattgccaaacctttcctgggaggcaaaattaccctagttgaggacttctagtgtaagactagaaggaaggacaccaaaatactcacagagggagacttggagcagagaaaaagctagaccatggtgaacctgccatcttgttcctggcacaagaatcctggaatctttagcatccttgccactgggccaaagcaccactccacacaggctgggcaccccctgcctgtaaaatgctgtttatccaaagagacgagaaaaccatggttcactgagggaccatcgtgaccaacacactctggttgccaaataactaatatttatggaaatcttacaagtaccaggtactgtgctaggcacttcatgcccattattttattcaatgccatccactgttaagaaatttacataacaagaaactgagatgcagagaggctgagccatttgaccaagattgccgtggccgctggcaggtgggttgattgagctgctgagccctggctgctcagtgctaactcttgttctttcccccctaggaccccagttttctggccttgtctcttccctgccccctggtgtcccctgcccagaatggagcacggcctggggaccctgctcgaccacctgtgggctgggcatggccacccgggtgtccaaccagaaccgcttctgccgactggagacccagcgccgcctgtgcctgtccaggccctgcccaccctccaggggtcgcagtccacaaaacagtgccttctagagccgggctgggaatggggacacggtgtccaccatccccagctggtggccctgtgcctgggccctgggctgatggaagatggtccgtgcccaggcccttggctgcaggcaacactttagcttgggtccaccatgcagaacaccaatattaacacgctgcctggtctgtctggatcccgaggtatggcagaggtgcaagacctagtcccctttcctctaactcactgcctaggaggctggccaaggtgtccagggtcctctagcccactccctgcctacacacacagcctatatcaaacatgcacacgggcgagctttctctccgacttcccctgggcaagagatgggacaagcagtcccttaatattgaggctgcagcaggtgctgggctggactggccatttttctgggggtaggatgaagagaaggcacacagagattctggatctcctgctgccttttctggagtttgtaaaattgttcctgaatacaagcctatgcgtgatcttgtgtgtcaggcctgtgttttctgagaaagccctcccattatccggggcagaattcaggggcagagttctctgtgaacctcacaaggtgaaatcacatggtcttaaagaaagccagaagacaggccttcaagtgatccaagaaacccaattcatattaataataattaacttttttatttatttatttttttgagatggagttttgctcttgttgcccaggctggagctggagtacaatagcacgatctcgactcactgcagcctcccgggttcaagtgattctcctgcctcaagactcctgagtagctgggattataggcgcatgccaccatgctcggctttttttttttttttaaatatatttttagtagagatggggtttagccatgatggtcaggctggtctcgaactcctgacctcaagtgatccgcccgccgcctcggcctcccaaagtgctgggattacaggcgtgagctactgcgcccagccaataattaacattgcttgagcgcctgctatgtgctaggcactagcactttatacagaccagtgcttcccagcgtttttgaccagagaagagcagggagaatgaaggctgcctcccagggactggggagcatagcctgaaatcaactaacccaagggtgaaattgttcgaagtctcatgttttattgtttacaaacaaaacaaaacaaaaaacaaaaacaaaaaaaaacacccaacaccaaatacatatattttacattttcctccatggtctacctgtgtttgtttaaaaagtaaaactgtatttccattaggatccaagcaggaaattagaaaacactcttggtatttaaacagggatttcttcttattaaactaattttattaaggtataatttacccatagttaaatatacagattttaagcatatggtttaacgagtcttcataaacgtacacgctcatgtaaccaactcctcaatcaaggtataaaacattttcatcatctcagggagttccctctggctctgttccagttatccccctgctccccaaggcaaccactgctctgatttctatcaccatagatgagctttcgtgttcttgaacttctcattaatacaaccatacagcaggtactctataatgaatgacgtctttcactcaacataataaaacaaaaggaatttaatgagaggacttagtcacccatctgagaggccaagtaggggaccgtgtgatgcaagaggagaaattcaacaccagaccagccctcggggcggaggggcagagggagggcagagcccagagctggcaccagcaggcagaggaagaggacctggcaaggctgtctgctgggagctgcagccgctaaggagacacagcctcgcagacctaacaaaaagtagatggaggtggggagacctgccctggcttctgcctgctgctatcccccagtttccagttatgcctcccatgagtcgaacctgctgggaaggtggaagagaggggagcctgggagatgcaggacaaggaagggcaggagggttctgagaatgagggcaattcccagacacagtgtttgtaaattacccaccccaggtacggttgctggtcacagaggcccctgctgcccagcccccaacacttatctcaggtatcaccccctccagaaaccttagtttgagaatcacatgctgagtttgagccatgtaaccttcacagagcccctgcatggcaaatataactaactccagctcagggataaggaaacacccgggaaagcgagctgtctaaaagctggtctgcagctggggtgggatgctagtccaacctgagtttatctgactcttgagaatggctgttggtctctcacagattgagaatttccatgggtctggttctgcaaggataaaccctaaacacatttccaggcaaaattctgataacatcccccaaaacagggagaacacggacaagaatgaggaatgtgcaccgagggactcccatacataaggctctctctgccacgcactctgtccacaccactgcacgtcatccttgggacattcctaaaggaaagtgccactaatactccctgtttagagatgagtaaactgagacccagagtgattaacaagttaccctggagtcgtggagctgggactcaggcccatgacctcacagctgagccgccactgtgcagtggtagagtgagtgggctcagccaacctgcccaggtgtgcatcctggctctgctatttcctagtgctgtcatcttaggcaaagtacttaacctccttgtgcctcagtttccccttctttaaaatggggataatggcaatactcaacacagaggattgttgaaagtgttacgtgatttacaaaaaaacttagggccgggcgcggtggctcacacctgtaatcccagcactttgggaggccaagacgggcagatcacttgaggtcaggagttcgagaccagcctggccaacacatcaaaaccccgtctctactaaaaatacaaaaattaactgggtgtgatagcacacacctgtaatcccagctactcaggaggctgaggcacgagaattgcttgaaccggggagacagaggttgtagtgagccgagatcgcaccactgcactccagcctggtggacagagcaagactctgtctcattaaataaataaataaataaataaataaatattggaggccgaaagattgagggtcatgatcaactcagtataccactggaagctatatgagtaagcagcagactatttctcataaatgcagaatgttggcaaactgacaaactgtttctgccatccagaaggaatgctgagggcagtcacgctccaagcatagtgtttcttgtgattaggcctaattgaaacctgttagtaacaatatgaatctgtgatcaatcaaccagctaaccagtcattacctcctcctccctgctcattctacccaataaataggaagggctgtggaagctcagggactgcctttgctcactagaagcagggagttctcttcttcttcccctggccctttcctttacaacagtttcttttgtcttaagttttcatttctacattcgtcccctcgttcagtcctgtaatgaagtctcaggcagtaacagtagtaactgctgtaatgacggcctcaagtagtaacagtaataactgtcatagtgacagtctcaagtagtaattgtggtagtctgcaacaaaataaaataaaataaaataaattttagcaaccgttatcctaactcttggcgctttagttttttgatctgtaaaatgggaataaatagtagtgcccaccccacaggatggctgtataaagtgagtacccggctgtgtgcagtggcgagcacgcctgtaatcccagcactttgggaggccgaggcgggcggatcacctgaagtcgggagttcgagaccagcctggccaacaaggtgaaaccccatctctactaaaaatacaaaaattagccaggcgtggtggcacgcacctgtaatcccagctacttggaaggctgaggcatgagaatcacttgaacccaggaggtggaggttgcagtgagccaagatcatgccactgcactccagtctgggcaacagagcaagactctgccaaaaaaaaaaaaaatagtgagtatccactccgcaggggtattgtgagtattaggaaggtaattcctccatgttcttcaactgaagctattattatcatcctgcctgcaattcttggcaagtgttgtgaaggcaaagactgggaatcctcttgtttgtggagaagaggaaacgtgtcgggggcaaagtcacaggggcaaaccaggtttaccctctctgaagctctcacggccacaggtgcccaggcctggccattcctccatgggaagcttctgcactcacttcctcagtgctggcctgggtctgcggggcaagctgagtgtcccggggcagaatgctttctggagaggactccgctaccagctgtggctgaaggacctggcacagggcctgttcctggggcccttggcacaccatcctcctccagccgagagccgtaaggaagaagtttccctagtgaagggcatcaacaggccccaggaggtcctcctgcctgccaggacacccgtggtcctccccatcctaactagttacaattaaaatgaatctagcaaacacagacagccaggccctcccacgccctgctctgggatccaggaacaacgacggcgcccaggggagcccacacacttaaggggagcagcttacagtctcactgtttattgagcagctactgtgttcttgatgcttttgtaaaccagaaagtgtctgagacaggtctcaatcagtttagacatttatttttccaaggttaaggacacgcccagtagagaggtctgtgcctttctctaaagatgactttgagggcttcagtatttaaaggggaaagcaggctggaggggaaagaaggagggtctggaaatccacatattgcaagagaaaaagagcaggtagggaaattatgtattcgattatgtattcgtctcacgctctgtaactttacataagataaggtgaacacagagtggctactcgtggagatacctggccttttatctgtggctctctgcttacgaacaaaggaaaggcagcttgttgcatgactcaactttcagcttagttttttccttttggcagagtgaattggggttttcattttcctttcacactttctataccttctcttattgaaaatgaggtggttgctgtgatctgcattttacagatgagaagctgaggcttgaagaatagaatcaccactcacaatccaggatgggaagtcagaaccagctgaaccagcggctagcccagcctctctccctctctctctgttcctctctctttcttctatctctctatgtttctctctctcaccgtttctctcttctgtctctctctctctcatcctctctcctcctctctttccattttgtttctcttttccttggctttttcttctttcttgaatttttaatgaagtataaaaagtatacaaggccaggcacggtggctcatgcctgtaatcccagtactttgggaggctgaggcgggtggatcgcgtgagctcaggagttcgagaccagcctgggtaacgtagtgaaaccccctctacaaaaaatacaaaaatcagccgggcatggtggcacatgcccgtagtccaagctacactggaggctgaggtgggaggatggcttgagcccaggaggcggaggttgcagtgagccgagattgcatcactgcttctagcctgggtgacaagagtgagaccctgtctcagaaaaaacaaaacaaacaaacaaacaaaaagtatacaaataaaagtgttcagttagtccagttttcacaaatgagcacacccatgcaatcagtacctgggtcaacagcaggaccatgcattgcctgcacctccaaaatccaccttggtctccctctcttcactacccacaagataatcactatcctgacttctaacagatagatccattgtacctgaccagaggcagcagccatcacctggagacttgttagaaatgccccatcccagacctacagaagctctgggagtagggcccagaaatctattttaacaaacctcccatctcgttaaaatcagacacagctccagctcgggggaggacagcagtgatgtgctgctgcctccttgtggcatttccatgcatgaacagccgagaggccacctgccaggaggaggctgtcttcaaggggcaactccaacagcctccctgggaggtacccctcgactttctgcctaggaaaggggaggcaaccaatggccaccatgtgtcaggtgctaacgaaaaggccacctgcctctccatggctaaaatgtggtctagggtctgaggtgcattctcagccatctgattctcaagaattcatcttttttcacttccactgacatgaattatgacatcagggagaacccaagggcagaagtaggggccaagtcctcttcatcacctccaggttggctgacaaacttggttgcaagtggccccatcacactggcctggtctttatctatggcccctttgtcagaggcgttagaccagagcaactccattttgagtaggggctgggtaaaataaggctgagtcctactgggctgcattgccagacgatgaggcattctaagtcacaggatgagatgggaggtcggcacaagatacagatcataaagaccttgttgataaaacaggctgcagaagctggccaaaacccaccaaaaccaagatggcgacgagagtgacctctggtagtcctcactgccacactcctaccagcgccatgagagtttacaaatgccatgccaatgtcaggaagttacactctatggtctaaaaaggggacacatgaataatccacctcttgtttagcatgtcatcaagaaataaccttaaaaatgggcaaccggcagccctgagggctcttctgtctatggagtagccattctttattcctttactttcttaataaacttgctttctctttgtggacttgccttaaattctttcttgcaggagatccaagaacactctcttggggtctggatcaggacccctttctggtcacacctccactgcccaatgccccctcaccactggctttcatgaaaaaggttttaacgtcttcgctgggccaggtcttttcatccagtctctgttggatggccaataacctaacgtgaacctcttcagcagcttctcccctgccctgaagccagcaggggtgggacacaggtgactgacttgactccctctaccctctcaaccccctcactaccactcacctcaaggacacaccctccaggtccactaacccccctgcctctctcagtctctgagacatctcactgcagtcccactcccctgccttcctctcttgacccctgctctgtggccatctgactaaaacccagagttggagaacctggtggtatcaccgcttactccagatggctgatgatctttatgttctggatcgggtctcaatccagaccccaagagagggttcttggagctcgcacaagaaataactcagggtgagtccataaagtgaaagtgagtttattaagaaagtaaaggaataaagaatggctactctaagtcacaggattctaagtcacaggatgagataggaggtcagcacaagatacagatcataaagaccttgtggtaagacaggttgcaatcaagaagtcggctaaatcagaacctggtggcagaaactggtgctgcgctgcctactccagatggctgatgtggcatctgtggaatgcaaagtctccctgagtcttttccccacgtcaggaagattgcttaagtatcagactgcagttgccagaataaatctaaatttattttaaatgttcatgtcaacagtcatatttgtaatgtttttttccttaaaaaacatgttgtacatatggatgttcgtcattgctatttatacctttatgcctgtctttattagctagggtaaaccagatcccagtaataaataaacccgaaatccagtggcataccaagggaccaggggaggtggtagtgttacaggaagggggtcccagtccagaccccaagagagggatctggatcttggaactcgcgtaagaaagaactcaaggcgagtccataaagtgaaagtgaatttattaagaaagcaaaggaataatgctccatagacagagcagccccgagggctgctggttgcctatttttatggttatttcttgatgatatgctcaacaagggatagattattaatgcctcccctttttagaccatatagggtaacttcctgacgttgccatggcatttgtaaactctcatggcgctggtgagagtctagcagtgaggacgaccagcggtcactctcgaggccattttgattttggtgggttttagccggcttctttattgcaacctgttttatcagcaaggtctttacgacttgtatcttgtgccaacgtcctatctcatcctgtgacttagaatgccttaaccatctgagaatgaagcccagcaggtctcagccttattttacccagcccctattcaagatggaatcgctctggttcaaatgcttctaacagtgggagttttctccctggtgagaaggaatattttaacactaatgtttagaattgctggcatgtggtgataataaaaagcagattgacttttagaccttttcattactgttttaaaattctgtacagacaatgtacccctttatcacctgcatccacttccactaccaccagcgccattggaacgtcactgccaaaatgcttactagccaaagcacaaagtctatgtgtgttacgtaacattccctatgggtgcttctgcttggtgggctcccctacatggtgatacagggactcaggatccttcgtctagggctcctccttcctctctccttctcccaatcatctgcatccagtaaggcctgactaggtcagggaggaagcccagacaatcaattcatggagagccggagccaggaagttgcacacagaacttctgctcttgtctcattggttaaaactcagtcacatggtcacacccaactgcaagggaggctgggaaatgtagtctatctacatttcatgtgctatcacaaacatccatcagtctttgccacaatgtcttaaatatttcacaataaagaaatgtcaaatgtttgtgttagacaagaatgtggataaactaccttctttctctagtataggaattttaccatgggacagatagtcatggttcaaagtcatgaaacaaatgatctcaaattttatactgtcccagtgaccagaatgctgagttcacagagctttccactgcctctttctcctactcagatgatttcccttctatctgagcacatgcctagactacatttcccagtctcctttgcagctaggtgtggccatgtgactcaatctttaccaataaaatatgaagggaagtgacatgtgccacttcctgacctgagccttacaagtttgtgtgcctgcttcgagttctttccccttcccattggctgcaaccctctgtgccccagcttccactgtgcagacaggaatagtatcctggggcagtgcagtgattctcaaacttgcagaatcactcggagggcctgtaaagacacagatggctgggccccacacctaaagttcctgattcgctaggcccaggatagggctggagaattgacatttctaacaagttcccaggtgctgttgaagctgccagtccaaggaccactctggaaaccactgtcctaaggaatgatggggtgcactatgaagaaacctgggtctctgagtggccccctggatcatagctgccttgacaacttggcagcgcagttgaaaaagaagtaaacttttgtcttctttaagtcactgcactgctgggcatctttgttacagcagcttaacctttaaccacactaacagagttgggattctgtcacttgcaaccaagagtcctgaccaatacagactcgaagcttaacttcagtaagttccgccactaagagagtttgcttcttttttcctgcttatcccaaacccgcagttttttcatcttaccttagtattgaccaggattccggaaggagatatgcacatgcaccaagccctaggaaggacctggaaggtggagaatattccactatgctacaatcttttcaaacattaacattattattatctcaactacttgcctgagtcccttgaacacaggcccagctctgaaatgtagttgccatggggtctggaaacagcccagacacccactcctcattggtgggtacctcttgtgctgttttcctggctctaggtgaacattcacaccgtgcaggtaaagaagggtgcaaatgcaggttatggggactcgtgtggctcaagctctaccttggaatgtgtggctcagagccctggggatcaagcttggcagtgggagaggaggtggggggaaggttccatggccctgagagaagaggactcacaacatcttcagggctctgtttcctgaggttaatgggccctcagcaaagcacttagagggtgtttctgtgtttctcttgcctactcctctgccatgaataggtgggccacaatggggtccatgtagaatagtgtttttcctatggtcatttagcaagtcttggacagagtccatttgagaaccaggcctcctgtctcccagcccagggatttaaaaaattatcccatcctagtttggaaagcagccatgtcccgaactgcaatatgggctctggcctttggaggaccagagagagcctagcaatggcctcttccacgtcctgaagaaagtactgcagggggtgggcacagtgactcacgcctgtaattccagcactttgggaggctgaggaggttggattgcttgagcttaggagttcgagaccagcctgggcaacatggcgaaaccccatctctacaaacaatacaaaaattagccaggcatgatggcttgtgcctgtagtcccagctacttggggggctgaggtgggaggatagcttgagcccaggaggcagaggttgcagagccaagatcgcaccattgcactccagcgtaggtgacagagtgagacccctgtctccaaaaaaaaaaaaaaaaaaaaaaaaaaaaagttcctgcaggcatgatatggtggtatttgacacctcttgtccgtccttggctttggggctttagctgtaaatctgagacaataggaaaagtcccatttaagagtctcttacatgtgtgtcatttaacttaatcctcatgacagccttatatgggaagtgtattaaagagggtaatgctagttgctatagcgaacagcccccaagatctagtggcttaacacaatagcagtttatctcttacctaatattgcaaggcaggtgtttgttcctggttggagagatttcctttacgtggtgatccgggtgacttccatgttgcagctttgccatcctgcagggctttgggttctctgcatctagacagacagggatggagaagctcacctacttcctcgaggccctgcctggaagtgacactcaccactcctgctcacattccattggtggagactagtcacatggtcacacctagatgccaaggatgctgggaaatgtagtctccagtggggcacatgtcttccagagacaattccacactatggagtcttttccagagttagtgcacaaagtcctctttactaatctgtttaaccagcttgccaggctaaccagcgctctccatgctctctgaatgcaacgctactgccccaggcatactgaatgcttatggctagtaagccattccctaggcccctggtcgcctttggctcttggccgtagaagagcatgcttgccaacagtctgctgggtctgttcccaaatcagtttgcacacagcacacttaatattgtaacaatgtaactgaattagatattccataaactgatgaaatatgagtgcaaaaggaagagatttgtttttctgaaaactgaatgaagactggttgctaaaaagaatactgtcaaattaggtgtggaagaaacaactacaaaacatctagaaaaaaaaaaacccacaagaatctagagggattctgcactccagttgccatacaaatgtctgcaggtccttgccccactttaaagaaaccagaattggccagggacggtggctcatgcctgcaatcccagcactttgagaggaattacaggtatgagccactgtgcccagcccctgcaggactttcttcaggacattataccagctttccttccctcaaaagcctccttagcctatataaagcgaagattatgaataaatgttaagggcaggtttctggaaccagacagcctgtatttgaatcaagcagtcctcctgcctcagactctcaagtatctgggacaataggctcacaccatggcacctggcttgaaatttcaacttaattcaattttaattaatttaactataaatggccacatatggttactggctaaggcattgggtagggaagctctgtgttacactaacattagcacatgtatttcttcacgtctcaggctctttctttgccttgactctttctagcccatgatgtcttgtgaaatgcaagtcctgcccccgttgattcagacagacagctcttgattccaacatattatgctgactgggaaagggaggggtggtccttggcaggaggaaaagggacaggcctctgtctgtagcaactgggctcaaattgccatatggcagcaactgccacctgtaacactgccatgctaagctcctcactggcagggaagggctgctgtcaagagcaagagctcagcagctggttccccctctccttggaattgtgactttgaaaaaaatctctgcatacttctgagcctcaatttccccatctatagggtggaattaacaatgcctactgttgttctgaggattaaatgaagtgaggcctgctttgtgcttggatcatactaactactcaatcaatgttctcgtttactctaactctcagagtcaccttccactcagaccaaataaacagcaggggaaaaaatagggtgggatggacagagagaaaatgttcttttaaaaagtgttttattggccaggcacagtggctcacacctgtaatcccagcactttgggaggccaaggagggtggatcacctgaagtcaggtgtttgagatcagcctggccaacatggtgaaaccccatctctactcacaatacaaaaaaaattagctgtgcatggtggtgtgtgcctgtagtcccagctactcgggaggctgaggcaggagaatcgcttgaatccaggaggctggggttacagtgagccgagatcgtgccattgcactccagcctgggcaacaagaacaaaactccatctcaaaaaaaaaaaaaaaagtgttttattgtgaaaattctcaaatatacatgaaagtagagagaatggtttagcaaacctctatactcctatcacttagattttcaaatctaaaacaaaccacagtaaaggtttttttgttttgtttctgtttgttgaggcagggtctcacgctgtcacccaggctgaagtgcagtggctgatggaccgacctccccaggctcaggtgatgtgatcacggctcactgaagcctcgacctcccaggctcaagtaatcctcccacctcagcctcccgagtagctgggactataggtgtgcaccaccatgccagctaatttttttgtattttttgtagagacaaggtttcgtcatgtgacccaagctggtcttgaattcctgggttcaagtgatctacccacctcagcctctcaaagtgctgggattacaggcatgagccaccacactcagcccagcgtaagggttttaataactccattaactcagagatatggatcctcatgaggctgaagaacaaactctcagtggctccaaggaaatggtcacaaacacatgttaggacctctctgagcagccctgcctaaaacccgttagagacagagtcttgttcagacaattgtcatttgtcccccaaataatatcctcatcggcctgggagcagtggtttcccccactgggtgtggctatgtgtttttctggtgatactcaagattccatctctctgggtcccccaaaccgtatgttttgtctttcagtgcccagaaaattatgagagaccccaaactcctaccagtaacgttgcttaaattagcaagagacagcttttaatttcttgtaacccagatccctaaatgacagtcaggctacagaaaagccacagcggccacctctaaggagctggcacctactgttccctgaggttaaaataatccattctttcaggagagagacaagagagagatgttattagggaacgtgccagatcttctggctttctggaaaattactgggctatagtctaactattagaaatcaatcccttaagatcccagtagccctggggaataggcagtgtggaaaagggcaaagaagaaattaattgggtggaggacagtactaacatttgctgggcatactctgtgctgagcagttcttcatacactccatttaatcctcacgggaacactgtcaggcagatattcctagccccaggtcacagacaaggaaactgaagctcagagaggtgaagttacttgcccaagacacaaccaaggtctggctaactctaacacccatgttcttctttgccactgccctaccctgtgtggccttaggtgagtctctctctctccttctgagcatcagtttcctctccctgagatgggaatggcttgcctggctcacagaggctttggaaggatctagactcctaagtgcttagaagcatgcccagcacccagcctgggactgggattgccttttttgtcatcctcaaagctgacaaccttggagctctgaaagaagaaaatccaaggccccgctgagggacgcgggtgtgcctctggggcgatgggacagaggaaaatcactgggttccctcaggtctccaaaggaggaaggaggagaggaggcagagggaggtaagctgaagggggaggtgcctcgggtgttgctgtttttggtgactgctcagctgacagctttccaacctgagaaacacacatacacaaagtctaacctcctctggcttaaaatagagccactgaaccaaaaatgccaagcacagggcagagtcatctgcctgacggagccagacagctcccccatggccccagtaacatccacccccagtgggcacacctgaccaagcgcctctcagctgcgcatcatggggccctcacaacagtgggcaagcaaagccagccacggatcctcggccccatcccggagacaaggcaagtgagagccagagaggcgatgggagggggataaagccagcagcatctggcctgacaaggatcatgacctggggaaccggacagccctgagttcaatcctggctcagccacagcctggctgggaggacttggcaggttaagtatctcttggcaggttaagtgcctctgtgtcctgggctgtaaggtgagagtcctgtgagtgatgtctgtgattatgcctcgcacaggcagagtgtttggccctgtccctgcttctggaaaaagaattttcgacatctgcacacagacagttgtgaaaaaggaggagaagcagctactggctaaggggcacctggatagtgacacaaaacagcttctataatcctctacatggtcctatggggtgagggtcattactacccccgtttctcagatgagaaaaccaaggcacagggaagtacaagtgttctgtttatggacacctagtggtatggtttggctctgtgtttccacccaaattgcatctccaattgtaatccctgcgtgttgaaggaaggacttggtaggaagtgattgacttatggaggcagttttccccatgctgttctcgtgatggtgagtgagttctcacgagatctgatggtttaaaagtgtttggcagtccccctcctctctctctctcccgctgctatgtaagacatagcttgcttccctttggtctctgccatgattgtaagtttcctgaggcctcctcaggcatgtggaactgtgagtcaatgaaacctctttccttcataaattacccagtctcaggtagttcttcatggtcgtgtgacaacagactaatacacccagctaggaagtggaggagctggaattcaaactcaggtcttattgactccagctgtgtccacaaccatgccctcattaactctcccctgagtgggccctgcccttcccctaagatcaggccattccccacatcccactgtctccacaaactcttttcgggctcttgttgggctgtgggtccttggagccccactcactccgactctgagacttcagcccaggtttctgctcctctgaagtctgagcagaaatcggaatattaaacttactgatgctgttgctaaaaatcaggctgaggtagtggcaccagcacgctgcttccagcccactgagcttcatcctgcttctcgggagaagaaggggtccaggccctctctaccaggtactggggcccaattctgcctgggaactgagtcggacaggcactgggttggacatccctacaggcccgggcgtctgctcacttgtgatatctgtaacagtggctcacacttctaaacaaatcctcagggccaagctcagctctccggctccacatctactggttcatttaatcctcacacccactgtattagttccctgttgccactgcaataagttattacaaacttagtggcttaaggcaaatgtattatcttctagttctgtagggtggagggctacacaggtctcactgggctcaaatcaaggtattggcaggactgagttcctttctagcggcttccatatggaagtatgtcctcctctgggacctggagggcctaggcggcaggctgggcctcaggggcttaacatacgtcagcgacttaatacaacagaagctcaaaactggggctcctgattgggggttgggggacaaccttgcaatgtgtcattcagccccaggtttttcccaccttgtgggctccctctcttctaaagactttagttctctgcattcagccgtctggtgggggaaagagatggagcacgtgtagggcagggttttatgggccaggcctggaagtggcatatgtcacttctgcccatgttccatgagctaaagcttggtcacatagaccctgctaagtgcaagaaaggctgggcaatgtggccagctgggcgcccaactccacctccccggtgcatcccggatcccctcatttctctccatcttcacacatttggactacactagccttcgaactggcctccactcctagccaccatcccttttccccatgacagccaggggctctttaaaaaatatgaatcagatcattgtggtggtgttgcgtgtgtgtttgtttgcctgtgtttgtaatacagcctttccatggctttcaataaacccacataagggcttgtaagaccctgtgtgaagttgcctctttgccttccttctgctcccccaaagtatctgccccccagttctctgggctccagcgacaccggctcctctgctattctggctgccaagtcatgctcagttctgttttaagcaccaccttagatggtggggttcaccttccccaagaaactatcccttttccttctttctcactcctgtcttaaattagtttcttgtttgttagctggccctcctcactaggatatcacttttacttacaacaggaatgttgtttgcaccagtaggtgcttggtaaatatttgtcagaggattgactgactgaatgaaagaaggaaggaaggagagaaggaagggaagaagagatgaagggacgaagggaggaagggagggacggagggaggaagggagggacggagggaggaagggagggacggagggaggaaggatgggagggaagaagggagggagggatggggaaaggagtgaaaggaaggaaggaaggaaaggagggagggagggaggaagggaggggaggggggaggggagggagggaaaaaggaaggaaggaaggacggaaggaaggacggaagactggcacgaggtcacaacatgagttagtggcgggaacaggacttctgcaggcccggggtttgggcctttgcttcagatctcactattcacagacacatgaaccccgggcaggcgagtgggaggcggacaggggagcggttcttccggcccccacccgtggcgatcccagcctccaggttcccggcagtcgccccgcctcgcccgtcacaaccctgccgcgtggggccggggttggagggggcggagcgcgcggtccgggcacacggagcaggttgggaccgcggcgggtaccggggccggggcgccatgcggaggccgagcgtgcgcgcggccgggctggtcctgtgcaccctgtgttacctgctggtgggcgctgctgtcttcgacgcgctcgagtccgaggcggaaagcggccgccagcgactgctggtccagaagcggggcgctctccggaggaagttcggcttctcggccgaggactaccgcgagctggagcgcctggcgctccaggctgagccccaccgcgccggccgccagtggaagttccccggctccttctacttcgccatcaccgtcatcactaccatcggtgagccgcccggagcctccctccgcgcccgctccagccccagccgtcccggggcgcctctgggtttcggtcccacctctgcccccgcccagctgagctactttggacgggtcatttcggctcaccgagcctccctcatctccttcgcctccctcgtctccctggtctcctttgcccccctctgctgaatggagctgtcagcccacgcaggcagggacgggaggaatcagtaaatcgagtttgccaaaaggctgacccaggagtgctcagaaaacgtccaaggggcttggagataggtgaagcggggctgggagaccaagtggctggatttgcttttccttgcctggttgcctcacacttgctgtgtgaccttagacgagttgctcaacctctctgagccagagttttctcttctgtaaaacagtgtcgctaatcggccttatctcagggctgtggtgagagttattattcaggagacagactatgcacagacaaggcctgtgctaaaacatgacacatacagagcactacaaagaaaagatcatttttttattattgcaattgttattgttaccccatgagaatggggacccagtctgtcttagggactgctgtatgacccgtgcctagcatgcagtagatgatcaataaatacttgttaaaggaatgactgataaccacaggctctggactctgccctcagggatgcagagcagttcctttggagcatctggaccaccagctgttgccatgactaccatctggctggtacctgctgagcctaaacctgggggaacaggaaggagagaagtgggctctgcagggctccaggcttggtgccagccactccccaggctccagctgtgaacgtcccggcaccccccctggggcttggatcaccagtccgaaagccagtgccttggagaaagtttccccataatgctcttgcaagtgaatatgagctgtggtttttgcagtggagttaaaagtatgagttctggaatcacagagactggagttctggtctcatctctattgccacctgccttctctggcaattgattccacctgtccaagccctggtttccccaaaggcaaaatgcaattgttcctacctcactgggtgactgccaggtttcagtgaggtcaagcatgtaacatgcttggcacagtgcctgaagccaagtaggcactattcatttgtaataattcattatttgccaacgtggctccagctcttattcagctcttttgccccctcctgtccacatggacacccctgcttcctatcttggtacacctgagaccctcctggttaccgtgcccactggtctgggatgccatcaacttgttctctctgcctttatctacattctttggaggcttgccatgtggttttggcctcttaccctggttctttacctctgaggtacgtctgggaggctgatgtaagagactcaagtggaaacaggaggaattttgccttttctggccacttgggggcaccaccaccctctgtggtctagtccgctgaagccagccttgcagagagccaggtgccaggccccaggaatttgggctttgcttggatgggagagaggcactgaagcaatggagggtgctggttaatagctcaggcctgtggagggtgctggttaatagctcaggcccgtggagggtgctggttaatagttcaggcccatggagggtgctggttaatagctcaggcctgtggagggtgctggttaatagctcaggcctgtggcctttgggcagttttgtccctctgaacctagttttcttatctataaaatgggaataacaacatgtcatatagtcattgggagggttaaatctgataatccatgcagagtacatacatgggttagttactgtcattattagttattatcattattcatttcactctctgccaaaacctggcacagtcccaaacagctggaagccttttattcctaaagagactcttctgtttctcaccagcacccccttcagcttggtttgattcaataaactctcattgagcttctggtctacgtcaggctctgtgcaggaccttggtgatggggactacaccaccatcgtccccgccctcaaagagctcaaagtctagtgatgagcagaccccctttctcccaaaagtaacagagaggcaaagtgatagggctatgcaacagaaatgtggaagtgcagccacaggcctttaaatgtatgtagtgctgatattctgaataagttatatatgcacacagtacacacttcacagggcacaaaagggtatggaatgaaaaggaattctccctcccaccctgtctctcagctcataaattcctcttcctgggtcaaatacagttgccagtttcttgtgtgtccttctggatatattctctgcctatatattcctttaaaacacacacattgtatagacgttatacacacagttttgtctcttacttttttcacttatagaatatatgttgatgtttttatgtcagtctctaaagagctgcgtcatcttgtttgtagggtttctcagcattggaactactgacatttggggctgtggggactgtcctgtgcattgcaagatgtttagcagtgtccctggcctctactctctagatgccagtagcacacagccatccccactcctcacccccatttgtgacaaccagaatgtctccagatgttgccaagtgtcccctcaaaggcaaaaccaccctcgattgagaactgctactctgtagtatcccatggtttggatggcactataatttatttaaccaggcccctttggatggacacttacattgtttctcattttcgctatgaccgacaatgctgcaatgacgacccaagtgcacacatatttttgctcatgtgtgtatattgaagggctaacttcctaactgtggaactaccttggtcaaaggatttgtattttttactttttggcaggtagggccaatctgttagaggaggcgcattcttcttggcctcctgactcttcctggcgtacaggctcctttgagaataccatgaaagcaactgctcctctttccaggaaaagacacacaatgagatacccattcattcccctgcaatggcgcggtgttccaggactcaagattgcccagtcgtgtttagattccctatagtagttgaagggacccagtaagaatcgccacgccagacaatcagaaccaaaaggtgttcagtgcgggcaggctgagcagtggagggggaggtagtcaggagaaaaggcatgtggagaggacatgctgactggggaagcagctcggggtgtagctggaaagtggggaaagttttgcttttttttcatcaaggcataatttacatacagtagaactcaccattttcctgtgtacactcctgacagatgaacacctgccgcgtaactgcagccacggtcaagacggaacattgccatcaacccccaaaattctaccatgccttctgtagttaagcctgcccccaaccccagctactggcaagcaaccacagatctgttctctgttgccacagttttgtcatttccagagtgtcatttatagggaaccatgcggtctgtaggctttcgagctcgtcttcctctactcagcttagacatttgagatccatccttggttgccgcaagttacaggagttcattcagttgctgaaaaaaattggtgtttggatgccccacaggttgtttatccattccccagtcgagggacacttgggttgtctgaagtttggggtgatgaatgacctagttaggactagtatttggagatgcccttccagccccggggacggggagggacacgccgggcaggcaggctgcgggcgggactgttgtcagctggagctgggcgctcacagccctcccctccgctctccctgcatagagtacggccacgccgcgccgggtacggactccggcaaggtcttctgcatgttctacgcgctcctgggcatcccgctgacgctggtcactttccagagcctgggcgaacggctgaacgcggtggtgcggcgcctcctgttggcggccaagtgctgcctgggcctgcggtggacgtgcgtgtccacggagaacctggtggtggccgggctgctggcgtgtgccgccaccctggccctcggggccgtcgccttctcgcacttcgagggctggaccttcttccacgcctactactactgcttcatcaccctcaccaccatcggcttcggcgacttcgtggcactgcagagcggcgaggcgctgcagaggaagctcccctacgtggccttcagcttcctctacatcctcctggggctcacggtcattggcgccttcctcaacctggtggtcctgcgcttcctcgttgccagcgccgactggcccgagcgcgctgcccgcacccccagcccgcgccccccgggggcgcccgagagccgtggcctctggctgccccgccgcccggcccgctccgtgggctccgcctctgtcttctgccacgtgcacaagctggagaggtgcgcccgcgacaacctgggcttttcgcccccctcgagcccgggggtcgtgcgtggcgggcaggctcccaggcttggggcccggtggaagtccatctgacaaccccacccaggccagggtcgaatctggaatgggagggtctggcttcagctatcagggcaccctccccagggattggaaacggatgacgggcctctaggcggtcttctgccacgagcagtttctcattactgtctgtggctaagtcccctccctcctttccaaaaatatattacagtcacaccataagcacaaaccaggctccagggtcaccctgtaggagcaaattccttgtagtccaaattgtatgagggcgtggccacatcagcacttaggagaggctctgcacaggtccacctcagagccgaccctccagagcaacttttctgttgtgaagaggctggttttctgagtaacggttgaaatgtgcaactttcaacactggaatcttcgctgcaattagtgaggtcagatgctcacactacgagaagcatggggaacaaaggtggaccaaatgggaccgtgtacagtccagtgttgacaagggggtcaatctcttgcgctaaacgatctcattctctgcccagtgtatagagtggaatcagcccatgtgtgaatgatggcctctttcccccagacagctgatgctctttgtccctggccagccccacttcaggatgagggaggccttgctgtcacccacccaccatgtcactggggccacttggacacagcagaatgccatgggacgagctctcttccgggtcctgtcaatcaccagcaatatgaccttggagaatcgcatcctctcccagggcctcagtttccacatctgtagaatgacggggttcatccagaaccctgctccctcttacgcatctctggcaggactttctggaacaggcccctgcaccataagggggcagagacaaagcccgaggtgtggcatcctggcaccccgtggcactcagccacttcccctggcttcccagatagggctgtctcaacacaaagcatgaacgagccaggttagaaaagccaaaaactttaatttcaacatgagctacatggtcatgaacacaatgcaacgcgaccccactccaacccaagggccccagaaaccctccctccctaaaggcctgggcggctgctgctccaagagagggaatgagggaaaggtgggtggatggagagaggcccccagcctaaggacccaggctcctgccttcccaccacccgtccaggaagcagtcataaagtgaaagggctccagaggtgatgctcacagccctgggttcggctccattctgacctccctgaagcgctgggttagacgggcaccatcagcccacctcacaggctcggcgtcgggtgagctcgtggacgctaatgctttctgtccactctgaggtgctgctccagatgtggggccctcccagagggcctcggagacaccataggggaacagggagaggggctcggtccctgggcctgacacagcactgctgctcaataaataaatgcaggtgaccttgcctgacgcaacagctgtgcctccagagggggtgggactcggtactgtttctgacacggaaatgcacccaggagctcctggctgaagggaattggcttgtgaagtacataaccaccccctaagccacctgctccacctctgggtgtaaaagagtgagctctgggctgttggagaaccgagttccagtcctgcccacccactaacacagtgggacctcaggcaagcactttcccctcccaggacctcagctccctgctttgaaatggggatgacggcacaggccaccacctactccccaggggctcttgtgagggccgaagggcacactcgagataaaagcattctgaaaacaaagtctgaaaagcacaacaggaaggccaggtctcactgcatctgaaggtttggggaggacttgcctgaaatgaggcgcccacagctgctcccattccctcactgccccaggcaggagctggtgtttcctaactctccctccagttggtcctgaagaggctatggccccttacaagggccctccacccaggcatcaaggtctagacccaatcctgtgtaccctcagtcagctgggccagcccccaaggagagctgagtctccctggcaaccctctcccccagacccaggcccagagaagtcactggtttatagaggtggagcccagtagggctgtgcagcccagggcttcgaggccaggaatccttgtcccagcagacatgcactggagcaacggtctcctgtcgcctgaagaacaatggagcccctagttcttccccctttgcacccttgctgaggggtcttgtgtgagtcacttcctgtttctgggcctcagtttcccaacctctcagatgggctacagcttgtcctgcccatcttttggggggccattaggcttcaaagaaagaagggaggaggaggtatgggcagtggcagccccacctcatactgccctggctccggctcagcctctattgggaggaggggacccaggctgggggtgccactgaacacacaggtgactccaggggtggcttttcccccaagctgggtcttgatttccttgtctgtaaaatggaaatggactaatggtcccaaaggcccttcaagggggttctggagaaggagagtggagatggctccttcccatggtatcctgcatgtgatcttggcccagagattgaaaacagtcatcccctggagaccccagccccccagtggcccctagtgccagcctctctgctcctcttcaaacagtgcagcctgagtcagcaaggggccaggcagtagcggggacaggatgggcttgaagcttctccgaagctaatgatgaaaatgtcactctcctccccaaacccccatcccttggtgaggacagaccgtagttcccacacccaatggtcacagcccctgggaaggggcacatgctcacgatgacacaaagaaacagggctccagcccccagctgctccacccctccaggaggtgagcgggatttcacagaacaaacaagaaaatcattgagggggccctcactgaccacccccaggtgttgttattgcttcggagctctctctctctttataaaggctgtgcagacaccaggggaagggctcaggctgtcagggccaagcccctgctccccctggttgggacagccaggctctgccctgtttttgaaaagctacccctgaacaaccacagcggtgatggctggagagagaaggcgctctcctggctcaaaatattccaatggtaagtaataaacgaacagcagagaaatcacactggttagaaaaacaaacaggcaaggggccaattctgtgccttgaatgcgaatccctccagagccctgctccttccacccccagccttgggattccacccaccgcggtcccaggaaactctgaagacctcctgggtaaagggggcgtctccatctccccttcccagtgcagggtaagcagctctgtggaggtgatatacattgaccagaactttaaagaatacccagggtttccacaggctaagggaagggaagaatttccgggtggaaggagttgcctggtgggactgggaccgggaccgggaccaggaacagggtgggaccaaaggcagcctgggtgtcctcaggagaaaacaacaccctctaatggagaccaggccccctctgccaaggtcctacaacccttaggagtccctcataaagaaagtcagtaccaagaataataaatcagaacagccgagtataacaggcagctccagctataaccctacggggacaagggaaggaagggggcggaggaggaggggctggcctcctgtgagccaggctgccccatctaggcccaggccagcgaggagacagtggtctcctggaatgtacttgaggctcctctccacccccggtcctgggactctgtaaggactatgcatgagctaagaacaggccccagggcttggagcactaactctacctagctaacctggactacgccctacacagcagggactaggtaaagagtggcaggcttctgggtgcctcccaggggaggtggcagaaatgtgcttctataaagaggggccagcctccatcctcccttgcatgcaaaagggctcccgcaggccccagggagggctgggctgggaaggcagctacccaggcctgctggaaaaggaatctcccagttcttacactcacgcctcttcacttttctctcctaccgccatctttccttcagccaaggtaattgaggccggggcagtgggttctgcccttagtataggatgttttttttaaaaagactaaaataggggggctctatttgcctccccagccccctggcctggaggcagggtgggtagacaggatgaccattgacctcatgcaacaaggaggggttctccaatttgagaaacccttatcttggcaccaccagtcccaatcccaactttccttagcctccccctccaatacagcacccccaaatgctctctagggttggggttctggaaactcaggttccacagctcctccaccggaacacagacgacaacattctttctagtccgccagcggttcctaaactagcttgttgcaatcccatggagcgaggcacctaggggtctgtgccaggcccccggcacctcctcctttcctttggtccctgctgaaccccaattcctagagccaccagaagaggggcaggcaggaggggacggacggatggactcggacaggctgcggcaaagctccttccacgggcaggcagagggaagctcaagctcctcttcaagtggggggctctgggcccctgggagctggctccggatccttgcaaagctgccccttcatctctggggcaggagtagctgcctgaacccggtgccgcaggaaagacacttgctggtaattggcaccatggagatggccggctgggttctggacatggctctgggcagcgagcttccgaggaggcaaaaagggggagaagttggacagtttgggaagggagagtggtctgctctgccacctcaatctttcctttctctggactgcagccacatccaccaggtcaagaaccggccaagtcaaaagtgtagccaatcccgttgggagaggggaggtctcgggggtaggaggcaaagaaggggtgaggaggggcccaagggggggcaggtctccccgttctgcttccccactgtgggggagagccccgtcctcctgttcaatgtgcccctgggcctggggtcccaggtcagggctgggtggtctccaggccatcttggggagcccctccccattccagcactaagatcgttctccgcagggccccacggtgctctcgagggacaactgggatgcctgccggagcagggggcctgtggctgggtccaccatggaggaggtggggaagagcttgtaccagcccacggccagggtggtcaagtccagctcctccagcagcacgcgagccacacccatgaactgcttccgctccatccgcccgtagttcccccacacgatcacctgtggggcaagagacacagtggttcaaatcctgccagtgccactcacaggcccagaagcagaacctgggtcgccccatgcccaatccagctcagtcctgtgatttctacctccttaaaactgcaattcctcaacaggcctttcttatcacggggcatcacaccaagcccctggcctccagaggctgttgatggtaatggtgacggtgacgatggtaatgggtagaacacttgctgtaggcaaaactgcaaatacttttcctgcacacagcacacattccactggcaccagaatgttatcaggtaggtactattagggtccccgctttacagatgaaggaactgagggtcagaagggaacttgttcaaagttgtgcagtaagttgtggagctcagttcagccacagtgaactgagggcctcgcctgtttcctccaggcgaggccctccagagacaccccccgccaggggtgccctcctctcattctggtactgtgcatgtgtgctcgtgcacacacacacacgtgagcgcgtcaatgcccctcacctggaggactttgccctggggactctcaggaaacagcagcacctggttatacagtgggtccagcgacttgcgagcgactttggtcttcttcttggcaatgcagatgccattctctagcaggtaggccttgatgtaggccgctggggatagaggccagcaggggtgagttctagtttggccctcaaatggtgggcaaagggtgcaacagagggaggctgcccaccctctgctggagataggtgtgcccccatggggtctggggaggacgcaccaggacacatggggggtgggcatttgggggcagcaggtacagctgggcttgggtgcagcctgccccacctcctctggtggtcctcactgtctccacccttcctttgctcactctgtgctcacctgtttcctctctcagtccataatgtgcccaccccctccctggcttatgcatctatctgctgaccccctcactcaccaagcctgagcacctactgcatgccaagaaccctgctaggcactggggtataatgataagctggaaagatggtccctgccttccaggagctcagtccagtggaggagaggaacaaggtcaacagacaatctcaactggctcttcaaacaaaccctaaactaccaattccacataagacatcagagttgggacagggggtccccacagttgggcccaattttctctcttcaaggccctcagtacccatcaggatatcctccctgacctccacccccaccttgcaggggaaggtaggccccagacctggcagtgtcttggagcctggcttggctgtcagtccccgagcctggataatgtccacctccaactgaccgttccgctcctgcagaccgatctccacatcccctggaagaggcaccaagagatgagactgggaaatggttcagaagctcaagcttggactcagctcttctcctttacttagggctgaaacccccttcccctgctcccagcccagaataagaccagaaccaactcccaccaagtgcctaggctctgctgagggcttgagagtgtgccctgggctctaggcggcatgcgcagaggatggatcaacaggcaaaggggaaggagggagagacgctgagcttctggtgtgacacccaactcccctagtccatttgaaaccagccttggggcactcacccatgggtgtggtggccagggtctggcggcccacaaactgtgccggccccatgcttcccaggaagtcactgaactgggcgtccgacgccaggcaaactcctccatagttaaggctgcaagaggaaaaggtgagacaaagcacacattcccagtggtttaccaacaactctggactcaagcagtcaacctccatgcaatggatatgctgaaacttccctcttgggatggagataaggtttacccagtatctggctcatgtggtttagtgccttgatactcaaagtgtggttcagagaccagcagcatcagcatcacctgggaactaattagatacatagaactgcagcccactccacccccagctgctgaatcagaatctgaattttaatgcgagccccagatgatgcccttgcacgtgaaagtgtgagctgcactgcaaacggctctagactctgaggggtgcatttcttgcggctgcttggctacctaatatccacttccccttcctctggtaacaagatctcaaattttctttacggaaccccctccccgtggcacatgatcacagtggggtggagggaacagctcctgagactgggcctccagctcagcctggccaatcagggcatcccttcccctcggccagtgatcagctcagagacaggcatgtagcccagttcagccaacaagaatcaggcctggaagctttgtttgaactatggggagtgagacgctctctttcccaccagacttgagcctgagatgcaggactggagcttctggtgctatgtagctaccatctggatcccgagaatgaaaccatcaaaatgacagcattgtgtgagctcctggatcaagctctgcctgaagcaagctacttcatcttttggttacgttaagtcaatatcaacagcaacaacaaagataattttattattttgcctaagacagctttagtcagttctccccactcccttcacttctctaagtatctctttcccatctgtgaaatgggaataataatgttcccatctcctaggtctgttgtattaagtgcgatgaggcactaagtaccatgcctgatgtgcctctgttatcctgagcaccaaagcacttgcaacccattttctcatctgatcctcaccacaaccacaggaggttttttttgttgttgttctggtttttgttttttttttgagacagagtttccctctgttgcccagtctggagtgcagtggcacggtcttggctcattgcagcttcgaactcctgggtttaagcgtttaagcaattctcatgcctcagcctcccaagtagctgggaatacagacgtgtaccaccacgcccggccaatttttgtgttttttagtagagacagagtttcatcacattggccaggctggtctccaacccctggcctcacgtgatccacccacctcgacctcccaaagtgctgggattacaggggtgagccaccacgcctagcccaagaggttggcttttgatctttatcaccatcttttaaataagaaacacatttgcccagcaaaagggtgaccctattccctggccagagatgaggcatacagagtcagaggcttaacccaagccaggccaatcaaaacctctctctgggaaataaaaaagagaatcctggagactaaaagtcacaagaactgagccatataaatggcctgccctcaggcaaaacccataaactctactagctacccagtcttggctgcccgattcttccctgaaccatttgaagtcccccagtgttctgtttttacttaagttatctgcagagttaatggcagaatattcagcctgagtgctttcccttttcctgatttcctactacccctggcttgctttccccattcagacagtagccagggtgtcctatgttggctgcctcagagaaggaatgacccagcaggaggtagagagcaagagacttgggctcttgacttttcagttccaaatctaagaaacagacttgaaagaataggtacaaaactaggctatcctgccccgaaacagacaaaccctcagcctgggagagcagaggaagtcaggcaaggagggaacagagctgagatgctgcaggatccttgaggacggtctgtagtctgcagctggtgagtgctgggggatgacagaaaactccagataggctggggggatctgaaagcagaggagacttgcacttactcttcttattgggtggagctaagaaaagggcagaacactttacagaaatggctacttgggcttcttgtcaagtaaccccctgggagatctctgaggctctctgtacatccctccataccctagagaggaacatatgatccaggtgcactggagagaagggcagatccatagaggcctggtggtctgggcaaagagaagtagctgagaccaatgagaaacaatgaccaaggagcagacagtaagatcacgttccaggagacaccaggatgatggatgatgattgcagaccacacactctgtccccagtgtctgagcaccacaataatagcagccaatgctactggacacgagccctcactgacattcagctggtacaccaggtgttatggccggcgtccatttgatccattcattcaaccaacaaatgtttactgagcacatactatgcactctattgtgtccaggcactattctggacacttggaatatgttagtgaacagtgatttctgcccttcaggtgcttagattctagtgacatattacacacaattaatatcataaacattacagtatgttagaaggtggtaaatgatagaaatcttagtaataaataagtagagaattaatgtgggcagggggggatgtgggcggcaatacaaaatagtgtgatcagtagctgtgacttgtgcttcttattaaatactttgatagttaccctgggcctgttctagaaatttacacagattctctccacataaacttccccaggacacaggcataacatttgggaaaatcctgaaccaagtgggtctaagtttccagcaaacagaggacacagcgggacttgatacagagattagcaacagcgaactcccagtgctcactaaatgccacaaatgtcaaagtgctctatacttattaattcatttcagcctcacaacaaccccatgaggtcaatactgttactgggcccattttatagatgagccggagagttaagaaacctacccaaatgacacaggtactgcatggccccaccctatccctcagcactcacctctatactttgaagctacctgctctcacacctgccactaggtctgagggcttattttctggctgtgagaattctgaattttgctggggaagcaaattcagcctgtggcacagggcaggctggaagcacctgagggttcatgcctcagaagcagcccccacccagtgacaaactgggagtctgcaggggggataatgcaggtgaatgttcacccagcctcccaaggctccccagtgggcctgagctccagctgcccttagtggtagcaggcttgatgacgcatccgttattagctcccctcccttcccatcccattccttgcagctcccacactcgggttgcctgggatggcctgccaaataaccagtttccacttgaatctttgaatcagggtctgctctggaagaagccaaaccaagacagaagctgagtggtatctgaacccagagagtgaggcttccaagtctattatcttaacaattatgcaacaatggtttttttatagacagaaagtatgaaaaaataaagtcacgtaagtgtctggggactgaaaggtatacccactattcttgcaaaaccaaagacccttaattaacagcacagaggctatggtctagaccaggggtccctaacctttttagcaccagggaccagttttgtggaagacaatttttccatggactggggcagggagtgggggatggttttgggatgaaactgctccacctcagatcatcaggcattagttagattctcacaaggagcttgcaacctagatccctctcatgcacagttcacagcagggttcatgctcctatgagaatctaatgtcatcactgatctgacaggaggcagagctcaggcggtaacgctcgctcgcccaccgctcacctgctctgcagcctggttcctaagaggccagggaccagtacccctgggggaggcccctggggttggggacccctgacctctttcacactggtgacatggcctttcctccatgcccctgggtctcttttccaccctaccctcccagccatctagggggccagcctccattttgtaaggagtgtctgggctccaaaagcctgagaaatggtgggggtctcacggattccaggcatggaaggagcgcagcctcccaggcagagggaggccctctgcagcctgaaattgaaagtttcctccaacgtcatcattgtctgcttctcagttcctggtgggattgtgagcagacaatggggaactggcaggcctggtaattagcggtaattgtttataatatctgggcggctgcctgatttcctatcccagggagccttgctagctgccaaggaacccggctgacgccccagaaaccctgaataggttatcacgtcctcctgggggctggaggaaggaggaataaagtggtggctgggccctactaggccagaaatccaactgcgggtcttccctggagtacacaagaaggcagaggccgcaaaatcaaatctgcctctacaactcactagccaactgcttgctgtgtgacctctgacaagttgttattgtctctgcatttcaatgttcttatctgcaaatgaaatcacactgcctcatggacagtgtctggcctttttgttggccagtgcctgtgctgtctcagtttcaaatgtttttcaaaatttctgcttacggcatccatgagcacaggggtataaaagagcttattgcattaagtgctgcatatgtgctacaactttgacaagtccttgtatgcaacaggagctcaatagatgttcactgccaaaccctacagcaggacttacactgggaaaataaaggatggagtgaagactggatttggcataacgcagaccctggatgccagtactgtacaacctgtggcaagtgtcttaacctctctgagctgcagtttcctcatgtagaaaatgggaataaatagtaattaccttgccgagttgttggggagagtcagagagctagtgtaggcaaggtgctttagcacagaggacctgctgagtgaatcaaagggtgagataccatggcctgctgggcctgctgcctggcctgggagagcctccttgccacattcttggcattttcatggcatttcagattctagacctgttagtaagtacagcatctggatgcctgagaataagcccaagccattctggggagtactgcagcagcgggtcccttccagggacgtgtgccacttggacaggcgcaaagccctgtaacaggattacaacccatgttctgctggccttttattttgtgttaatggtgaaatgagattccctgcatttcaaatcctattacttttgtttgtggagctgaaacccattggtcttttattattaacctctgagcttggtttggcccctggattttctgtgttcttgatggtgaaagaagtaactggctcacgcaggggtttgactccattctcttttccagatggatcactcgtctcaacagcatcagaaattaaaaggttgcacagcccttgtggtgattataggttatgtgattctcaaaggtttaggagtttacgggttccctgtccatccattcactacatgctcacctatccatccatccatccatttatccatccatccatccacctatcacttcatccatccatccatttatccatccatccatttatccatccatccatccatttatccatccatccatccatttatccatccatccatccatccatccacccatccatccgtccatccatttatccatccatccatccatccatttatgcatccatttatccatccatccatccatccatccatccatccatccatttatccatccatccatccatccacccatccatccatccgtccatccattcatccatccatccatcctcccacaaactcaccaagcctacaatgcaatcaattctgctgtaacatgaaatatacatttctaaaaattactgtgcaacgcaaaatcttgctataaaaatcacacagcttatgggaaaatggggtcagtgtcacatcaaaaacagaaaaaggcaagaatgcagtaaaaatgaaagcatggttttaaatatgttaaatgctttagaaatgcacaaatactacaataaaaatggcatttgaccttgaaaatgacctgcagtttgcttgtggaagtgggtgtcggaagaggtgcagcctgtgagtgattgtgaggtggtgagggaaaaactgaagtcaatggaaagttgtaccaccaggtgtggacaggtgtggcttataatagtaaactgagggtgccgtggatgtctgaggcgcatgtgttttgtgtattcttatgtgggtgcagttttcttcattcacccagtgctcctcgtggatgaaattgcacctgaacaaatgcaaaatttatgttatgctcaaattgttccctaatacttgaatcatgttggaacaaattctcgttttcaaaacaagtactgtagcagaattgccctgtgccaggatataccatatcatacaatcctgaccccgacttctcaaccattcaaggtatttccaagcctgaccacctctatgagactgtgtgtggctcatgggtgcaaagccaaggatttatttttttatttgtcaaaaactcatcttgagccaagcactgatagtactatttatcaatgttgatccatttaatcctcttaacaactctataaaagctaggtatttgtaattaatacccattttataaaatgggaaactgaggcacagaattgttaagtaattgaaccaaaatcactctgctaggagtggcagacctaggacttgaacctggagagtctggctccaggattcaccctcctaagcactgcgttatactgtctctatttgccctgaggggacctcagccttgcccagagcaaagcacagggatttgcaggtcaaagctacggggtcaggcaggcctggaactgaatcctgactccaccactcactagtcgtggaggcacattcttcacttctcagagccttggtttactccccaggaaaacaggaataaagaacaataggataatcccagtgctgttgtgagtattaaatgagataaacgccttagaacagagtctggcatactcaaatgctcaagaaatactagtgcttataaaacaaaacaaaacaaaacaaatccctgtctcctagccacagatgcatccagctctgctttgtcctttgggcacgggaatgctgctaaatagtagaggtggggaagaaaagggggttctgaccacccacccaggctcctgagcctttggtgattaggaaacagccttggtagaaccgtgaccctgagcccgggttcagtggccctgccactgccttacactctgcttccctgggctgtggacacagtgacccagacactcagagacctggatgccgatgacccagacatctcgggacaacaaagaacagagggaagaagcaggtgggtgctgggagccagcctggagcgcttctgggtcaacagagaggatgccaaggccctggattctgtgtgctgaaggggcgggaaggagtgaaatgtatgcatgcttctgctcacacacacccacctattattcatcagaatgtgcagagcaccaactgtgggccagctagacaggcattgaactcagtgtctagtgggacagacagacacacatgtgacaagatagagagtggagggcactgtggtgggggagggacaggggactgtgagagctgctgatacagccagaggaacggtaggccctacccgttccattccacttctgcccacgcccaggacagacattgctaatcaacctcagctctcctgccaagcctggacttggctccagaatccttctcaacacagcactccagggaaccactatcaattactggtgttggcacatgagatacagcctttgtgccagttctcagctgaggtctggagaaggaatgagtcagagggtgaagggggagcaggggtagagaaggaagtgccaggtagagggtgcaatggatgcaaagacctggaggtgagaaaagtgaagggtaaaggttcagggtggtggagtccccacatggatggggactgggagaggctgggaaaagtcagaagaataagtgctgggtggcaaactgtggtgttcaaccaaaaaggagacctgtaggtgtccaggcaagagcgatgtatggccttgaccaggagatggaagtggggaggaatggatggattcaagagatcattaagaataaaatggcacagcatgattatggattgggaatggattatggattggagagggggaactgtctgcaagaaccccagatttctggtttgggcagctggggagatggtagccctgtgcacccaggcagtgtagcaggctctgctgggccatccccccaccccttattatgtcagtgcttgctgacttctaaccgccagagtctgcatgcctttgcccaggcttctctggcccctgaagagcttctctagcctcaagagcctatgttaccacaggaagagccagagttaacagggagcagccactgctcagtaactcgttaagagctggaatataaatacctcagctccctcacttcctgaggagataactcccaggtgcatgtttcacatgggttccgagagttccccatcaggattggctctggttgcccaccaggaaagctggcttcttaaagcatgctttgttgggtgcatcacctctctcccacatgctcctctgctattattttctagaatcacctcccaggtgaatcacttgcacttgaacccatgtctcaggtctggttctgggaaaacccaaactagaacacacgtcaatagggagtatctcaggattagggcaggtggggagtatggtatgtctggaaggttctgttctcacggccccatctcagagggcttgagctctagctcctgcccttttcctgggtgagatgggcctggcctggtggcatggctggttgactctgcatccttaacccacagagctccaatttctgatcaggcagaaacaggctcaaggaaagaaagcccttccccagccccaggggatcaaccacaactggcccagcatgaggcccatggtgtggaaagagagaggggctctgggtccttgatggcatccttgaactaccaaaccatcctggaagcctctacttccaaaaaacttaataaatgcaaccattaaagagaaaaagagtgtaaacattaagggcagatacccaatgcccggatttgaatcccagctcagccactgactggctgtgtgacgtggggcaacttatttaccctctctgagcttccatttcctcatctgtaaaatgggaatattaacagtcccattgtcaggttgttgtgacaattaaatgagtcaatataagtaaaagcccagcacagtgtctgcacatagtaagtgttctctgcaagagttagccacggccattattaccattaagccagggcttctctaccttaatgtgcatacaaaccagctgggggtctcattaaaatacagattctgattcagtgggtctggggtagaggctgagattctgcatatttaacaagctcccatgccagtgtttctgggctgtggatcacacttcgaatagcaagggctgaagccattgtccattggtattacataacccgggactcaaggcatcctcactgacagagcgacccaacccacaggcaccccttccccatccctgacaccttgctgggaacacaacatttcccaagttttctatacctgtcctttgcagctctccccacactgctagttgcttagtcagtgcccaagagtggaagctcatggaggacaaggtatctgaggtgcctgacccaactgcctggcacattctaagtgctcaatcacatctgctgaaatgaaaatcctgtgcctacctgcaggaatacatacgcctggtgatccagcgcagtcagacagacccagcggtgccaggggctgcagccttgcgggggtgctcaagtggggctggctccctgtaagcctcagctgggctggcagaagcccaaggggtggggagaagggagaacagtcccttcctgtttcagagcccggcatttgggccaaaccagtgcccaaaatgcctacagaacaagaagtctgaccacagctcaatgtccccacccattccttctgtgtccctacctcgcccaggtgttgggcaggtggcagcgcctcgcctggctgggatccaccaacactcagctcttttcaggaggccaagactgtcccctgctgctggacccgtcaccctccaacccacctgatacctcctcagttgggctcagaacacccacctcaagccttttagtaatcgtaatcctcacagccaacacttactcagtgcttactctgtgctaagcactttatagacacaactgtatttggggtggctcactatatccgttagaatgcaactgaccaaaacagcaaaatagccaacaaacagtggcttaatgaacaacaaacaataatagctaacaattacagagctggtcactgtgctaagttcttttacatgtattaacatattgaaccctcacaactctgtaagtgtctgcactgttatgtcccctttctatagatgaagaaactgggctcagagaggtgaagtaacttccccaaagccacacagctactaagaagctgaaatgaaccacataccagggcagtctcgtttttgagtcctggctttgaacctgtctgtaattagactctctggtcccttaaaacccattacagcaaacagtaacaagagccatgttccaaacacctatcacctgcaggcatcacctcgtttcttcctcataacacactctgataatgctccccttggtcatgtggcctttctgagccttcatctcctcttctataaaacggaaatgcaggtttgacttctctgctgctgctcactgaagcacgttgcccttcccacaatctagtcctccagacctgcccgtgaggctgacagatatttactggcctcaaacatgagagaggtccactgatgtgctcaagcccacccaggggcatgagtggcagagccaggattaggacctgagcttcctgactccctgagactcacacctgtcagcagggccccactgctccccagatgctgagaatatcttcctccaagttctgctgccttgccatgtttctcaggttaaagaaaacactggctcccttcctcctcctcctcctcctctcccttccgctgtcctcctcctgttctcgcccacgggaaagtctcgctaggaggtgggtggaacagcagcatctgctaaggcaaggccattcacgaggctgaagatgcccagtttaggaggggctgggggtggggaaggcttttagccagcagaagcccccagctgaggggcagggccagaatgaagggaagcaaaagtggaggccaagccccagccccacctctcagtggctgtgtgtctgtccttgcacaagtcacttagccagtactgttcaaacgaattttctatgatgatggaaatgttctattttctgcaccacccaatatggttgtcgctagccacaagttgctagcgagcacttgaaatatggctagtgcaatagaagaacagaaagtttcatcttatttaattagccacatgcttctagtggctacttttctggacagttgtggaatttaacttttctaagcctcagtcttcccatgtgcacaagaatcatgatatcccaccccacttccctgactttagacgatagctaggaccatgaagcgatgcagtgctgggaaataacccctggctgggagtcaagactcctgggttccagacctggtaacacacttcatgatgcagagtgagctctttaacctctctgagtgccctggtcatctgtatgataaggaagttgctttggatcaaagtttctttgatctagggatccatggatggttttaggggactctgataacccctacagttatgagaaaagcatgttcgcaggactgtgtgtgggagaatgagggtgtacatgcactgagggctgtgtgtattgggggaaactgggcccaatgctttcctgaaattcttaaaggggtctgtgaaaatgagaaacccctagtctaggtgagttgctctagggtaaaagctttttaacagtggagttctcaggccacactcccagagactaagtcagcagcctggatgtggggtcctgcaagctgcactggtaacgtgttcccgtgattctgacgcggagcccacagagggaaacgctggcaaggagccagccacactactgtctagtgagctgatgctcaagaaatgcctttataaagcagtagtatacatttttcaaaaccaacgggatttaggaaactaaaaaagtaaagaggaaataatgatgataataaaacccctttctacccctcctttatttcttaagcagcactaatatacagcacttagtgccaaacactgctttatgctgtgtataaatatcacccctgcattatatggattgtaaacgtctaatcctcataacacccctatgaagctgatgctgttaatcccattttacagatgaggaaactgtggcttagagaccttgcccaaggtcacacagcaggaagggggtggagccaggattcaaatccaagcagcggggctcgctctccctcggggctttgctgttacactgcctcccttctgaagatgggggatgaacctggagccctgagctggcgctttcacagcctggagctgccctagggctcccagaggggttgctcagtccctcccgtgccccaccacaaaagactgcaagaaccaggagggctggtggccccacacttacttgccctctgagccatagctgttcatgctgtcctcaatggactcgtggctggcctggcgcagtgtccggctgggcatctccactgccaggcccgtctccgtgctcctctggatggcccccttcagcctccggctgtccccttctgggcaaagcggccaagagagatgggaagagagacacaggtgggagggggacagagagaagagtcatctggttagcagtgtttcagcagctgggggctgtccagcttcagcctccaccctcagcccatcaacctcctcagactcctggcctcaccagtaaccactccaccaacaaacagtattgcatgagttctgttaaacgatagattcatttacatgtgctttttctcccccttgaattcatttctcccctgaaatcttctccaaatcatttctcttcctcctcttcagctactatttattgagcacctactatgtgtcctactgtgtcaagtgctttgcatggattttgaccagggtttcttgacctcagcagactggctgtgtggatggcatattgctttgcagtaggggctgccctgggcatcacagaatgtctaacagtatccctggcctttgcccactagatactaatagcaaccctcaccccaccccgctgcagtccagttgcagcaataaaaaatatctccagacattgccaaatagcccctaggcagcaaaaatcacccttgattgaggactactcgcactgaaaccagatggcatgggttcaaatcctggatatctatctcagtggctgggagacttaaggcaaattactcagcctctgtgtgcctctatttgcacaactgtcaagtgggagaataacaggctcttatgaggctaaatggcccccatcagccgcccactccttccattctgtggtcaaacatcatcttatccaagatctttcttgacctctcctggcccctccaaaacagcagccttctcccaccccctgcccctctctgccctgactcctgctttggttttcctcctaacacttaccacccaaatgcgttaaacaatattggtgttttggccagcttcctctgcgaagaccataaactccatgaggacagggaattttgttcactcttgaagcctcagcaccaagaacagggtctagaccattgtagagctcaactaataactgtggctgccttgagagcagccttaatcctcacaaccaaccgtaaggtggatgctgctgttcacccccatccagtacccaaaacaggaggcacggagaggtcaggacttgtccacgcccatagagctagtaaggtggggagccaggacacagccccgggagggtgtctgctccctgctccatggcctagtgattcaagggactgtaggcttgctagaggtggggtagatcattagtgggatctttttcatggtcccacaaagtccagacatgggctgattcccaagaggatccttcaatgcttgctgattgacccactggggaaaagcagccccaatcacacccagtcatcctcctcctgccagaggacaagagagctgggcctgcgtacaggagcagggcaagccaggacagctcccgccggccttctcctggcctccctcctcctcccagctccaggatggtctctccttcctccctgcctctaagaatcacacacacgtgtacacacacacatgcatgcgtagatacaaacactctgtttctcagaacgtgtagcctcgtatttctgtctcccacgtgtctttgttattcagacacacagacacccacactcagaaaaacacagcaacacacacacacagtaagatgcatgcaaagacagtgtgttaatgcaggtctgagtgtgctcccaggggtctccacatgcctgtcgctctgtgtgtttgaggctaagtgggtaggtgtatacacatcttccctgcgtgtttctgaacacgtgggagagcgtgtgtgcccctatatctgtgtttctactccattccatcatctgttctttccctagcttgcatctgcagcctcccccgaccctctatctccactgtttctgttatttctctgtgtacagcaggtacagtgacacagagaaagaaagaaccactcacatgcacattcagaaacagactcagacagagatgtccctgtacacacacacacacagcactgtacatatgtccctgtcagacgtgcaggaacaaacaccccccccacaccccacactagggatacagacccatgactgggcaccctgcaggcaggcagcacacacctgcctcggctccctccctctctgctgagcgctgttcaggtgcccccaccccggatccatctccacctacctgggtctgacacatttctcccggaagagggaggagcagagcatgacaaacaactcagtcccccagagctgtgccttgcatctgtgtggcatcctacagccctcaaagcagttcccaaccaggccctaggatctgcctcccagcagccctggctccccacacaggtgagcatgcctttgcagtcagaaggcccaggtatggagacccggggcaagctggacggcatcttcccacggagctgttgagaggcttaaatgacagacgtttcccatagtgcgggcacaaagtaggtgccaaacataaaaagccaaaccactgcagagggagaaagaccttccaatgcccccacacctgcccttgccaactgtcttgctgacacccttgtagactcatttttttcccttgacacaccaccttccccaagctagggaccacgactggacccaaccacagcaatgtccaccatccaacctctaccacctacccctcctgtgcatcctctcttgctaactgggccatggcccccaaagtgactgttccagtgctttcccaactacccccaccaagatccatccatcccacgtggctgagatgtgttccctttgttctgctcttcctcacttccaaatgtcactgtgattgttaatagcgagtgtcaactcgattggattgaaggatgcaaagtatcattcctgggtgtctctgtgagggtgttgccaaaggagattaacatttgagtcagtggactgggaaaggcagacccaccctcaatctgggtggcatcatctaatcggctgccagcatggccagaataaaagcaagcagaatgtggaaagactagactggcttagcctcccagcgtgcatcttcctcccatgctggatgcttcctgctctcaaacactgggctccaagttcttcagctttgggactcagactggcttccttgctcctcagcttgcagactgcctattgtgggaccttgccttgtaatcgtgtgaatcaacactccttaataaactctcctttatatatacatctatcctattagttctgtccttccagagaaccctgactaatagtcaccatcctgacctttcaccctgcctggccctcccctcctttctgaaaggaaggggccgtccttctcctggctgtggctgatccatctccatcactcaccatgacctcctcccccatttgtcctctctgggccttgcgtctgctgcctctccatcctcgggccctttctagttctcccacctctttcaccaactaacttcctcggagaacagcctctggccaccaagtcacccaccacaccctctctgatctctcagtgtggctccagcccatcgatccatcagggcggcttactaaaccattctctagtgactgctcaccaccaggtctcaacccagctcccgggccctgaagcatggccctttcattctctcaacagacatctattgaacacccttttgtgaggtggaagcccctgagatgttaaacacgcttctaagtgctgcacctgctgataaaacacactgacgggagccagggagaaatgaacagcctctgcttgtcgtccatcaggacccagaaatagaccctcacttgacccactgtagtgaacaatgtgatcctcctccaagaccccctttttaccacttctgtgagcccctccccactgtagcatgctatgtgctgtggcttcccacagccagtacctggcacctttttctggggtggggtgtgggggtgtctttctttgggctactgagcccatgttgcccccacacaggcagagctagaagtgtctggaaatgtatgacccttaacctgcccttgccctgccccttcatcaaagactaaatgaaatgggaggatgaaccctcacctcctctgccctgggtcagaacaactctgaggcttcacgcagcccccagagtaaccccacagcggggctggggccaccctttcgggacctgcctgagagcacaccattgcgtgtctcctgccctgtcttgttctgcttccctgggtctgttctgggggcacttccttcattactgcctccacacgaatctcatctcagggtctggtttggggacacctgacctaagacaggctggcaccctaagcaagtaaaagttcaaaaatcttcacacaggtgggctcccgcatcataactgtagttgtacccatttacacccaaccagcacattgggaaggaaatttatttctcttttgtatgcttctatgtcatttgaattttaattaattctataatgcaaatgaaagtaaatacaaacaaattcataaataaatcacagcttcagtcatgccaccatcttatttaaaaccttagccaggcgtggtggctcatgcccgtaatcccagcactttgaaagacccaggcaggtggatcacttgagcccaggagtttcagaccagcctgggcaacatagcgaaaccccacctctacaaagaaaaaatacaaaaattagccgggcatggtggtgggcacctgtagtctcagctactagagaggctgaggtaggaggatcgcttgagcttgggaggttgaggctggttgcactccagcctgggtaacagagtaaaatcctatctcaaaacaaaaacaaaaacaaaaacaaaaacctcagaatgtttcttcactgcctgctgaattaggttcagtttttgcacccaggcatccaagactctccattttctgactccctccccatcagctactgctctccctcgcagtctctatatcctagcccagccagacacctcagtgctccatcctgagaaatactgtacatcctcaataacttcctcatcctggttctcactcctctcctttcctccttatcaaatttctaaccatcctccagagtttagctttaaataacacctataacttatcaggcactctgtacttcagtttcttcatcatataatagggataaaagcaccagaatctcagggctatgtgagcactaaatgttaacaagcaagcaacgtaaaaatgtaataacatataaccctcaggatggcctaggtgggctgggacacacggtcagccctcaacaaagttgactattattaatatggttattaccattgtgctagatgccatgccaagcgttttacaaaggtatctcccacttaattctcacaataaaccatgagatagctactgcccccctttacagagaaagaaaatgaggatcgagaaggttaagtaactttcccaaggacatgcacgactactaatggtggagctggacttcaaacccaggctattctggctccaaagccatgttttaaatgcaccctaaagtaaactctccaagctccatcccagaactcaaatgccatgtcttccacaaagacgtccctcatcagactccttgagtcccggggcacttcaatcttcacttctcttggggtaactattccatggcaccttgaaacacagttctcatccacctagtcgatgtcagtgtttacagcgtgagctcattcgtcatttacttccattcagcaccagggatagcgcccacactgcccatccccactgaaagtgtgttaaattgaattggctttaggatgtgtccccaagaaaaatggaaattctctctggtaaagaaaacaagtagatgtcactctgctgtttatacttgaatatgaatgtgtttaatgtacgttctcccaaaagcaagtattcataaggaacaggataataaaacgatgataaattatgaaaacagattctattgtttttagcatttaccctgtaccatgtacaaattatatacacatatataatttaaccccaccataacactgaaagacaagtattattatcctaattttacaataaggaaacaggctcagagcagttcagcaacttgtccaaggttataccagataagacagagctaggcttgaaaccaggtctgtgtgaaaacagatcatcatatactcttaaccacgagacctcagggatgtgttggggggagggagaaggagagaactcaaccagtccccactttgacattttattgaagatgggcattatcagctttgacttccagatgaaaagcctcaagccaagagaggctccatgacctgttccaggtccccaggctctaaaaccactaaccacatcctggtcagtgtgagtgtccactccaagtccatagagaagcctgtgaagttcccccagacacaagagctctgggtgactgggttattttaaaccaggatgcgaaaggcaccaaggcccctggctcactgcttccccttcccacagccactactcttcctgtatctctgagataaataccctggagactgctgcctcttcttcctccatggtcagcctctccctggcctagttattcccagtgacttgggcctcacatgcctcccttgtccaggtcttgaagtccatctgaaaatcaagggctgagagccatctgcagatactcaggcctccagagcactgatgttgcctctggctgtgtctccaaggatgggtggaggaagcacaaccctgattacttctgtgagggccctaacctttcccttctccctggagctataggaatctgccctaccttaaaataagagatggtttcatctggagggaacttagggatcatccagatcaatgcctttattgtacagagggcaactgaagcccaaagaggggcaggagttaaaggccatgttggtattagaattcaggctgggtacagtggctcatggctgtaatcccaacactttgggaggccaagatgggaggactgcttgagcccaggagttcaagaccagcctgggcaacatagtgagaccctgcctctataaaaaatttgaaaattactagcccacactgtagtcccagctactcaggaggctgtggtgggaggattgctggagcccaggagtttgaggctgcagtgagctatgatcacattgctgcactacagcctgggtgacagagaacctgtttcaggaaaaataaattctggtctcctaattgctaacctccctgctccttttcagtcaacagcctttcactatttctagagcatcttcaggaggcagcatggcctaatggttaaaagcatggacaatggagcctgaatgcctgggttgtaaacctggccccagtcactctattagttgtgtgattttgagaaagttactcaacctctctgtggctcagtttcctcctctatgctaactggtgtccacaccaccagagtgtcctcttctgccagtttcttctctactcagtggcctgcctgagcttcccaaatctcaatcctgaacacaccatccctttgattaaaacccttcaatggcaccccattgcttgcagaataaattccaatctaacacacactgtctttctgacctggtcccaatttacatttccatttccctagtgttctctacattctattcacaatgaattattccaaatcttccatgtgaccagctgcccctcaaatttcttacccatcatcctgcatacaaaagtcttagcattctcttatcttctggagaaaggtgctttttaagacaactgtttgttgcaggataatatacataaagaaaactgtacaattatatatcgcacagttgtaagtgtataccttgatgactattacaaagttctacggaaccagcacccagatcaagaagcagaacattaccagtgccctacagaaggcccacatgccacttccagttactttccaccaaaagtagcattaccctaacttctaacagcacagactggttttgcttattttgtagttttcactacataaaatcacctagtgtatattctttagcatctggcttcttttacccaacacgacgtttgtggggttcatccatgttgattgtttcattgcagttcattcattctcatgacttattgtagtacattgtgtgaatatatcaaaataattttcatctattctattgctgatgagcatctgggtgggtagcctccagtaatgagatattacaaatagctctgccaaaaacattcttgtatgtgtcttttggtgaccatttctgtgcagttcttcagggcacatacctaggagtgcagctgctgggttacagggtatgcatttgaaatgccttttaggtggattaaccacggtgtgaactggaaaggttaacacgttagactatcattcagcaggaagcaatgttctgaagaagtgaggctaaagattggaagattttgaggaaaaagatggtggaaagcctgttgatttactgtatatctggctcacatttatattccccaaatgtaatctttgttaagagaatgtgtatacagggcaaacagcacccagaacaggacaggaaggaggggaaaaggcctgtaatacagttgacattcaataaatactggctattactattaacctctctaaaggtcaatggtcaactgctcactgataccacctctagtaaactcattatttcatcgattctaagacaagcattttttcaacatctccaaaattaagatgtgaatggcaaccagtggcatgtcagagttaaattctgacatgttttagctcccttggtggtatataaagttgtgacttgcaactgaaggcctctaaaatgcgattaagtccacagcaaagaactggcgtgtgcaggaactgtccgtggtgctgactgagcacagaggactgggcctgcctagggcagaggtggggctcacaagggagattttagaactacgaagcatccctatctgtggttgttttcaaaccacaattccttcccactggcttgctggtgcctgaaattccaccctcaaagaatcatcttcccacataaagacaggaatttccatttatcgagttgaaccagagcctatgagaggtgctcagcactcatcatttcatgtaatcttcacaaccaccagtgaaggtaagtattgtcttcattttcagaagggaaagctgaagctcaggggttaatgaacctgcccataattacaaagctggcatgtgggatgtgatcctggttcaacgcaggccagagtgcaatttttgccctttacgctgctctacactggagggagggataagtgcctcagacctttttccaagaggatttgaagaggaaagaggagagatcataaagacacagagatgaagtgagtgaaagcaagaggggcaaaaggcacatgataaggatttgagaaccctagagagggaggggaaagattttgtgagaatcaactgggtaataaatatggaatgtgctttgtaactctaaagggttatgcccctggaaggaaacgttactctcacttatccaacaaaatatacatttattgagttcatttcctatgccatgctgttcttgtctctggggatttgaataagatacagtctttgaccttaagaaacttacaggtagtagagtgtgggggggacatgaaacagataagtaattattattcattcaacacactctttactaattgcctattcagggccagatcctgtgcggtagactcataacatagatgaattaaacccagaccttgctgaaactcccagtctaccagaatagataggcaagtaaaggggcaattgtgcaataattacaacgtagcataatgtaagggcagagatatacacagagtattatgggagctgaggagaagggtaattaatgcagcactggagttagaggcacggtctgggttgtaagcagaattgattcaatgctgaattatacttgattgcaaataaaatcagaagatttcattgtacatgcaagcactaccttccagtacaactgaaggttatactgacaaataaaaacatggagatagagtgaagaggaaaatgtggaaccaaatgaaaactgaaggcaaaaagttccagatgcagagtaaatgcatttggggttggggaggtcctatgctgagcaggggtggtcaggggaaagtcatttactctcctcgagccaatgtggaaagactttctaaagaagaggcatttccacaatcattggaaggaagacaattcacagtcccacaaaaagctgtttttcctcaggaagctatttccatcagcatttgggacaagctaaacaagccttggaaggaactgggttgtgggcaaaaggtagagtctatggccccatatggcactgggaagctacacaatccacacagcattcaagacttccaggatttgccccaaacctatactacaagtctgccatgatgcacataccaggtgttctatccacacggaattactcatcattcaccaaatacagcccacgtacttccgtcttcttaggagaacaggctctggagccagaaaaactgagtttgggacttgaagcatgcctctgccactttctgagtaaactaaataaacttactgaactaatctgagtctaagttcccctgcaaaacaggaaaaatgatagaatccactccacctattgttgtaaggattaaatgtactagtaagctcttattaggttatgctgcaataacaagttacccccaaatttcagtggcttacagaacaaagttcttgttcatacttaacataccttatttttctgagatggacttttgctctgtggcctatactggagtgcagtggcacaaccttggctcactgcaacccgtctcccaggttcaagtgattctcctgccttagcctcccaagtagctggggttacatgcatgcaccaccatgcctggctaattttttttttcctttttgtatttttagtagagatggggtttcaccatgttggccagtttggtctcaaactcctaacctcaaatgatctgcctgcctcagcctcccaaaagtgctgggattacaggcatgaaccaccatgcccagccatacttaacatactttacgagttagctatggttctatcccacgaactcatctgggacccagggtgaaggggcaggccctatctgggacaagctggtctcatggcagaggaatgatggaaccatgagggaattcttccagctgctgcacttttctctatgtgtatttcaaaacttttaaaagaaaaggaagggaaagaaatatggcctctaacagacagatgctgccaaacatgtaggggaggcaaggaagctccctcctctccacaaacactggaaagagaactcctcaagacaccaaatggtttgttccaacaaggtagcatattagcccatgatagcacagatccatgttaactgtgaaatagatctctcataccccttgtgggactgaactcaatgacataacatgtgcacaacgactgtcacagtaagatacaggcactcagtaaattgcagctactattataaacaatactctgagatagagagtagtgtccctgattctcagaaactctcagaaaactgaggctctgagaactgaagcagtttgcccaaggtcccacagcaagtaaaggttggagaggaagaatgcaaaacaaatccgctccattcaaacaaagctgcacacaaatgttcacagtagcattaactgtaacagtcaaaaagtggacacagcctgaatggccatccatggacgaatgaacaaactgtggtatatccatgcaattaagtattattcagccataaaaagcatgcagtactgggccgggcatggtggctcacgcctataatcccagcactttgggaggccaaggtgggtggatcacctgaggtcgggagtttgagatcaccctgaccaatatggtgaaacactgtctctactaaaaatacaaaaattagctgggctgtggtggtgtgtgtctgtaatcctagctactcaggaggctgaggcaggagaatcacttgaacccaggaggctgaggttgcagtgagctgagatggcaccactgcactccagcctggttgacagggagaccctgtctcaaaaaaaacaaaaacaaaaacaaaaaaaaaacaacaaagcattacctatacatgcttcaacatatatgaaccttgacattatgcaagtgaaagaagctggtcataaaagatcatctcttctatgactctacgtatttgaaatgtccaagataggtaaatccatagaactagaaagcagactagtggttgccaaggaccagagggaggggcaaatgggatgtgaatgctcacgggtatagggttgacgataatattctacaattgactgtggtgatggttgcacaactctgtgaataaattaaatattaaaacccactgaattgttcactttaaactagtaaactgtatggtatatgaattatatctcaataaagcttatataaatctccttccacttcatctcatctcccaggccaggctgttaaccctattctacactgaccccaagagggtcaaggagcccacaggcagggaggctccccctaagccagaagcagtgtggaaaacctgctgcaaaggccagacaaggccaacttgtacagtctgtcccctcggatgtcatcttcagataacacatgtgcacatgtatccccacaaaggcccacggatgaaaacgtgcagtgggtacatgggaagcagagatgtaggggatggggtggggttggaaatgagggaattccttccttccagtcccaccagggcaagcctcaggctccccatcaccaccttcctcaatcaacagatggccagcttcctccagagcctccaagactagagctagcaaggcttagttaagaccacctgaaaccacctggcaccagcactcaccagagcaaacccaccttggactagctgttctcagcactgaggctgtagtgatgttggccttaggcagcacatcccctgttgctccagcttggctcatccacgtcccaaaactgcttaaaatccgtctctctccagactgttctgcaggatagcagctaacccagtgtccactaaggcttctcaagaacctcccacatacatgcttaacgcacgctgggtctcctactccttggatgagcagcgctatcctttatcttgaagcagtttaaacaaatctcttccttgatttggccttagcagagttgcagagaagctgggccccaccttggctaaggcacctcccttggttgcttttctctctctcaaatgagggcagggacactggctggcactcagcaggtcctccacacagacaccaaaggctgaaggaattccagctcatggcttctcaactttaatgtgcaaatggatcacacaggaatcttgttaaaatgcagattctaattcagcaggtctcaggtggggcctgagattcagcacttctcacaactcctaggtgaggtcaatgctgctggtctgtggcccacacattgagtagcaagattctagcccattccattcactcttttctgatttctctgccttcttcattgttcaaggagcctcttgggagtggataaaagctactctctcttagaaaaggacctgccagcacatacacacagtatgttgcataaagtttgggagcctgcaatccctggattaaaagccattcttcttctttttttttttttttcttttataagagataggctgtcacccaggctggagtgcagtggcacaatcacagctcactgcagccttgacttcccaggctcaagtgatcctcccatctcagccggtactacacaccaccaagcctggataattactttattttttgtagagacagggtctcgccatgttgcccaagctggtctccaactcctgggctcaagggatcctcctgccttggccttccaaagagcttggattacaagcatgaactacctaccatgcctagcctaaaagccattctttcgcatacacaaacctgcaaatcttagttcctgcagaaaagaggatgcaacaggggatagaaaaagaaaaagccttggcagggagtgagaactcctgggtcttgtcccagctccactactgacttccggtgtgacatcagacaactttctgctcctctcttgagcttcagttttcccaccatgagagaagtggactagattggggatgatacataggttttcttttttttttttttttttgccaactctggtagctgttgcctgaaataccctgtgctaagaattcttagactgtgcctggacttggcagaaaaggatgccatgattgattggtgatgcctgccatggtcccaggaaagggggccttgattgattggtgttgtctgccaagatcccaggcctggagggtgatgggcttcctgccagatgtccgcctaccccagagagcccttccagctgtgacattccacacagctcattcagagtcatgccacactgggcaaagagaagtctgtgcctgtcctcaagggggcaggaagggataattctttaagcttctggcttctcaaacctgctgccctacagccccctttgagaagaggtagcagaatccctgctcagtggcagaggacagcatgtccttgtgctcccatccttccctatttttaactccaaggacagcagctcaggcagaagctgaaatatggaagggccacccagcctctgagggaggggaaccacacccccaccatcattcccaaactgctccatggttggccaagtgagagtcgaggcaagggacagaaggttcctcacctcccgtgtgaatctctcacagccccatcccatccttccccaggcagggccagtcacccctccttggtacacccacagacctctctgctagtccctatcctgctgcaccctgtatttgttcattcatgcaccccatttacatatatgtgccagccttcatactagtgccgaggacgcagcattgaacaagacagatgggggtcctcacccactgagctcttctagtctagggtggaagacagacagcaaacaggatggcagcataattctgtagttacaactatagtctaagtgcttagaagagaactgtaccatggtcaccccatgtgcctgtacactcctcaagaactggaattctctcactcatctttctatccctggaacctaaggcctaagctggcagaaaggagggttcagagattatttgttgattgaaaatattacacaagagacatcatgtgaagtttgagagccctacaggagcctgtctcagactagatgagattcattcattcattcactcattcactcacaaagtattttttttgagcactttctacatgtccaacacggttctaggcactggacctagagcaggaaacaagacaaggaaaaacgaactgtcctcctgaatctccatgctaggagaggcaagcaaacatcaagccagacaaatacagaaagatagagaggatgctagaaggcaataagggcagggataggagtttctctctgaaacagagtgatcagagaaagcattcccaacacagggaacagaaacgtaaaggcccgtggcagacatgtctggtatgttcgaaggagacgagagtggctggagcagacagagcaagggggagtggtgtgagatgaggtttgagatgatggggcaggaggagagggcagactgaaaaactgacacacctcacaccaagctggcatacaattgatggaagagatggtggcgatgatgataatgacaatgacgatgtgatgataaaagcagctagcattcattgggcacgggtgacaggtgctatgctactcaattaacatggatttgtttatctaatccccacaacaatctgtgaaatatgtcttatattatacccattttatagatagggaagctgaggttcaacaaaatttacgcagcctggaggtggcagggctgggacgggaacaccggccgcctggagccaaagtccactggcttgctgatcacaccctgtcctgttccacatgcaccatgaacaccagtttcctcccctcccagagttcctaaatcttttggactcctttgaaaatctgctgggagctgcttttccccagagaaaagttttggttttctccaggaaaaaaaaaaaaaaatagagatgcacaatgatacaacttgaacgtaatttcaagaggttcaaggttataaactccagccctaaaagtaagcattttataagcatttataacaaaaacaagaattttcagagttttccaaagatgcaataggggaacacaagtgtctgcaataccagctaaaaccacttccatacaatttgtcaagagcctatcaggaataaggcacttgtagaatcgtatctcatttaaacctcattttagtcctgtgaggtgattataattaggatccctttacaaactaggaaactgagacacacaaagtttaagtaacttgcccaggctcacagaggtggtatctggcagaattgaaattaaccacagatctagctggctccagacctcagtctctattccagacattctcttctggcttctccaatggcatttcttcatcttcccagacaggggaagaaacttgctcaaggtctcacagctcagcacatctggagtagccattagccacatgtgaacacttaaactttaaaaaaaaattaagaattcagtcctcagttgcagggatcacatttcaagtgctgagtagccacctgtgactagtggctacagtatcgcacagtgcaggcacagaacattttcatcattgcagaaatgtctattgggcagcgctgggctagaacttggtctcttgactgccaattttagtttttccactgtcaggggctactagaaattagatttgcttgataaatgaagttgaccatgaagaggagacaggaggtgggtgcagtggtccatacttataatcccagcagtttagaaggccaaagcaggagggtcatttcagcccaggagttcgagaccagcctgggcaacatagcgagaccctgtctctcaaaaaattttgaaaactagccagtcaaggcggcttgtgcctgctgtacaagctacttgggaggctgaggtttgagcccaggaattcaaggctgcagtgagctatgatcacaccactgcactaaaatctgggtgacagagaaagaccctgtctctaaaaataattttttaagtgggtgattttactacccacttaaaaaaaatgatactgatgatgctgataacagtgactgccatttagtaataactttttcacaatgtactccatcaactggagcagggctgggcatgtattaagcactcaataaaaatgtcttggatgttgaatttaccatgaaaatgtcttacagaacagtaataataataaattactatgaagtgaatgccttacggctgcactgcacccaaccacacttagtgtcataagccttccaataacctgaggggtaagcactgttattgtctctatttacaaatgaggacaccgagacacagcaaggttatgtcatgtgtttaaagacacagctaacagggtagaagaaaaaaagggagagggtggtttaaatccgggtctgtctgaatttaaaatctctatattttttacctcccaaatcaagagagcattttgtgtacaacaaaggtctgtacaaatgtcacttaccagtatcatcacagtatgagaatttctttttattattataatttttttgagacggagtctctctctgtcacccaggctggagtgcagtggagcgatctcggctcactgcaagctccgcctcccagttcacaccattctcctgcctccgcctcctgagtagctgggacggcaggcacccgccaccacacccggctaattttttgtatttttagtagagacagggtttcaccatgttagccaggatggtctcaatctcctggcctcgtgatccgcccgtcatcacaatatgagaatttcttatttttttgagagatagggccttgctgttgtccaggttggagtgctatgacacaatcgcagctcactttaaccttaaacttctgggctcagcaatcgtcgtacgtcagcctcctgagcagctaggactataagcacacgccaccacatctggctgagttttatttattatagagatggtggtcttgctatgttgcccagcctgggctggaactcctggcctcaagcaatcctcctgccacctcagctttccaaagtgccgggattacagtcatgagatgagccactgtgcccagcccaacatgtgaagattaatgggcccagggagaagaaggattttccacagttgagctgcctgtcaacagaatggggagattgtgagctctctttcctgttgctagaggcacccaagggagaataaactcctacccagcagggagactgggatgggaactgagctgtggtccccaggtgggacactggatcagcacagagaatcccaaatgtggttgaacatcagaatcgcctgggagcttgtgaagcaacagagtccaggctgcacgcctgatttttaattgagtggtctgggttggggatcaggatcctggctgctgacgaaaggcacatgcagcgcaggttgagagtcatggactagcaaaatgctgagtgtccttcttacccaagatcactggattacaggccacggagccactaaaggaactcaggacacactgttaaaaaacatatgatttgcccaataataatgaaggcatgctctggccaggcactgtgccaagcatgacacctgtggtcccatagacccctcctcccaggctacctcctccccaggctcctctaccctccttccatttttcaactccagcatcctctcttccaggaagcctcccctgattcccagagctggggacctctccttggggtcccacaacagatatgattctcacttgtgaatgtccgcgtctatgtttacccgctgccactccaggctgtgacaatgctagtgtctcactcaagtccttgtgcccagcacctagggcctggcccagtgcaggtgctcactaaacatctgcagagaggacttgctctgctccatgaaggatggacagaggaggcagtgaagaaagcagccgctgcaggaaggaagtaatccaggtcaccaggttggaaggagacagaacctacaaattctccccgccactgttcagaagaggcctgggctatttatagctcacaagccttctgcttcttgcatttaaatgcagggccaggcatagaataaaatcctggggaggtctgtcagttttcaaatttatttatttattttctataagaacgggagcagaaagcagggacaaaaatgaaccatgcctattagggtgcgctgcctcgtgctgtccctaggtctgccttgccaagtctgttgacagaagagttgcacgcagttctagacctgatcctagaaatcagagtatccctgtggagactggcctgtgaaggtccttttaaggtgatttttaaatggtagcttcagcttacaaactagtattacagcatgaccctgctttggtttaaatatgtgttgtgtgtgtgcacgcgcacgcgcacacaccccctagagagaaatagccctagtggtgaagcattctacttttggattatagaatttgagacattttaattttcttttggtgtgctttctctgcattttcccaaaattgccaccatgggtgcacatagcatatacggtgttatgaggatgttagactcaaggaaaccagctctgccacttgctagctgtctgaccttgggggaattacctaatttcttcatctgtaaagtgggaatagcgacagaacctttcttagaggtttgctccaaggattgtataaggtaacatatgtgaaatcctagcacggcatctggaatgtggcatgtgctcaggaaatgccagctagtataactggacaagcatttgtaactcgtgaaagcatgataccgtttttaaaaattaaaaccacaaatggcgactctcccactcccgggtgtggaaggagccctgagaagggactggatcatggctggctgaggagggctgagaggcctgagttccaactcgacctgcctgaaaatgcacaaatgactccttctcctcttgatcagttttctgactttgaaaaggatggtggtaaggggtggatgttaagtcctgctcctctaagcagaggccccagaggcctgacgatgatgctataactcagatctccaagaaggagctgatcgtggtcccacccaccccctttcctagctccatttcttccctgtgtccacttcctaatgtacctgctttgccccactgagacgtaaataaaccccaggaaccttcttcctaatcacacaggaccccagtgatctggggcaccttccccacatccagcctagtaatcagcctctcacccttcaaggtgggactcagcactctctgctaaatggaatcaccgttatctgctctgcttgtctttcctcctgggctgagaaagtcctggtcctatttagcaccataacttcagtgcccagcacactggagtgggccagtgatatctgttgactgcataaagaatgctgtaaaatatgatccagggcagtgccgagcagtgggtgggctcacagactcgagtgtcaggcaggtcagtgtttgaatttattattataattttttttttttttgagacagagtttcgctcttgttgcccaggctggagtacagtggtgtgatctcggctcactgcaacctccacctcctagattcaagtgattctcctgcctcagcctcctgagtagctgggattagaggcatgtgccaccatgcacagctaattttgtatttttagtagagacagggtttctccatgttggtcaggctggtcttgaactcttgaccttaggagatccacccacctcagcctcccaaagtgctgggattgcaggcatgagccaccgtgcccggcctgaacttactattgaatggccctgggccaaagatgggcctgtcctttctgagctttagtttcctcatctgcacaatgggtatgacaatggtatacccctcatagtctgacatttcagtaagattatccaggtaaagtattcagaatacctggcatatatgaaataataaatattactatcataatgagaatgattattaaaaatgtaaaatgacttggtggctatctccagaaaccagtttcagcactttcctttcagatctggttcgggtctgtggggtcagaagaactcccggacagagtgctccctgcacaaaaatgcccgactgagaaggggcacaagcagaggtacagcctgttttcccttacccagccgtgcaccctgctggcactggagaaaggggaaccttgttctgattcatcctcctagaggaggcagcgtttttaaaattcaaccaccaggatgggggtagggagagaagtgccttcctctaacttgcataaggatgccatataagcgctgtgtctggaccaggtcctcattatggggccacgagaggaagggccaccctgggctgtgctcactctcagttctaaggataacacaaaggcccctccaagattgtgcggcccagggcaggagtacaaatggaggacttcatacttattctaaatatgtaaaagtttaaatcaggctattaaataaaatatgttctatcttttcattctgacaaatatgtcttcataatgaccttcaaggccaggacagctcaaatttagaatcctccaagtgccacagatgaatgcggagggggagggagccaaccctcagccatggtccaccctttctccctctgctcccatatccagagggctcactctgcacatctgtgccggctgtcgcctccacaaacagcaccttcagggccaccctcaggatactgctgatggatgcatccatcctcaggagaatgaagccagggaaggggttgagacagaccctgaaagctgactcagggccatttgggcagggaatttcagggtccccacgtctagaacaggcctagaaggaggagttcaggtgggtaataagagtgaagccagaggcctgactggaggagggtcagagaacattccagtaatgctggcgacctgagatcagggccctccttgcccaggtctaaaggtagaaatgaaggctgggcatggtggctcatgcttgtaatcccagtgtattgggagaccaaggtgagaggattgcttcagcccaagagttcaagaccagcctgggcaacatagcgagattctgtctctacaaaaaaaataaaattagctgggcaggctggcatgtacctgtagtcccagctttttgggacgctgaggcaggaggatcacttgagcccaagagtttgcggcttcagtgggccatgactgagccagtgcactccaagcctgggtgacagagtgagaccctgtctctaaaaataaaggcaggaatgagacagtacccaattctaccgccagccaggtctgatattcaccaaatgggtcatgagaaaactcacaagaggtttataaggggtgattcctttgggaactgtggtctccaatttttaccaaagcctttcccaaatcaacagatgtaccaaccacttgggggtgaggtaggcatgaagcttctctcgctttcttccccagcaaggctcagattgaggagtcgcatctgtaggccccatcccagcctgggccttttctggggctggagacattcagaccccactcccaattcctgaccagggttgagttcgtcaaccattcaaacttagccttaactaaagagcggttttcctgtatttttttattttaattttttaaagacttagacatttacctctggagagaaattatgggcttcaagagttcttgacaaagagcttcgttccagaaatataaagccggcattttaaatttggttcttattcactgctggaaagtattagaatgaagattacaaatttaataatgtaacacggcaggaactggcctggccttgtctccaggagagtaatttgttcctgccttcaaaccggcacttcccagcctcccggcatcaccagaccagcctggtgccacactgctgactttttttgtctcttgcgcactggcccacgtggccagcccagacaccaggagatatcactatcctggcctgagaactagggatagatggtcagatctgtctggggagagccactataaccaaagggagccatctctgggtctcttggcttcactccttgcctgcggccagagaggtatttaaagattggcaaaccccaaatctgagtttgtcacatccctgctaaaaacccaagaggggttccaactgaccttaagctcaagcccaagagcctcacctttaaaggcctagtatcatccagttctgctacctcccaacaacatacccctttccctgggctttcaaaagaccatggcccactcctgcctcagggcccctgcacaactgctaatactaacaagagctaacatttattgagcactaattatgtaccacgcactgtgctaagggcttcacaggtgtcctctcacccctaccctgtaaggtaggcaatggagccaagtggcgaagctccagagcccaaagagctggacttgaattctgccttggaccctgtgtgatcttgggcaacttacctaatgtttctgtgcctcagtttcctcatctataaaatagggatagccagccaggcgcagtggctcacgcctgtaatcccagcactttgggaggctgaggcaggcggatcatgaagtcaggagatcgagaccatcctggctaatacagtgaaacccc[133 bp omitted]cactccagcctgggagacagagcgagactccatctccaaaaaaaaaaatagggatagcccccaaaacaacctcacagagtagttttggggctcgaatgagtgaatggaagtgaagtgtcagaatgcaaggggtgccatgtgagccatggtaattatctgtatcggccttttacacagagagaaacagaagcaccaccaagtgaaaaataatgtggaacaggtcacgcagcagctaagcagagtgtggtctccagactctgaagcccttaatttttaccatgatatgcccattgtagaaaatctggaaaatacaaaaaaagcacaaactagaaagcaaaaactatccataattctgtcatgcagaagcaattatagttatttccatctgtggggagaggggagcgggagcgggagagacagccagagagtccaggattccatcccccttcccatcactatcaagtctgtgttcacagcatcctgtctcaccccctcccctcccctgccgtgccttcacttggccaacgctactcacacctcaggtctctgctgagctgtccccctccctgtgccccccacccaacatgtcagttctccctgctatggcctttcccagcaccctgtacttgtcttatatgcctctttatcacaggcatgatcggattattagttgcttcttcaagctgtgtaatgtccaacaacccccctcaccccaggaaccagaatgtaattccatgacaacaaagactggacttgccttaggtcaccagaacacagcttggccatgagcaactactggagaagaaagaaggaaatagagtggggaggaaggagaggagagagaaggggaggaagggaggggcttgggattcaactctgcctttcccaagtcagtgcccattggtgggatgcagatgggaatcacacagtccctgccctgcaggggctcacagtgtgacagtgaaaaagtgaaaagccagactgtgcaagcacaggagaaggagaaaagcaaagtaccacaggggctcccaggaatggtcacctccaccctagagaagaagggtgtgcttcctggaggaggtgaccctggagccctggagaaggagacatcaggcaccccagctgaggaaatggcctaagtgaggcatggagggagaaaactcaaacaagactgtcaaatatgaagaagctgggttttgcctggaaggaacaaatgcttggaagagctgtaaatatgaagtcaactaatctggctctatacaacacttgtttcctgtgttcatcctgtgcctttctagtacattctccaaatagtcaaacaagccattcctctgagctggagtgagcaatgctgtcattcctcatgtcctaaccccttgtcctagcccagtctcctattgccagcacctgcatttctctgcctgagggctaccacccatggcaggctggaaataaacaggcaataaccaactctctgatcttccctagcagctcttaaccaattactgatgggaactgctgtataaatacctgagctccctctttcctgggtgggataactaaagcgcgtgttctaccccaggagtctgcaaactatgggcctcggactaaatccatcttgctgcctatttttgtaaataaagttttattagaacacagctcaccctttcatttacatattgtctggggctgctttctcactacaacttcatgattgagcagttacaacagagactgtaatcctgcaaagactaaaatatctactgtctggccctttacagaagcagcttgctgagttctgtgctacactgtctccccagaagtccccagcaagactaaactccagttgcccttgcttgggttaacctgcctgataatacacagtctcctgacttctttctctgcctcactttctcactcccatcctggggtttcatccatcacctttgtgaaccatatgaagcatacaaaattctattagactgcttccactaataaaatggcagtttcaggtggtttgccctaatacttgtacttgattccttgtgtcaggctctgttctgggaaaacctaaactaggagagcagggcaagtgtcatcatgcccattttacagacgagccctaatttaaagctgttccctgcacacacattgtctcctcagcaaaggcagaggtcagccttggtttgagacccttcccgcactccccagtcagagccttgccatgtgtctttgatatgtgcagtatcattaaaccacctgtaggttacctcctgcttatagctgtgaacctgttcatctaatgaggaaatcaaagttcaaagaggggaatgacttgcccagggtcagttggcaaactggcagaaatgagatctcaaacccaggtttctttatgacaaatccagggctcatcccacgacaaatcaactaccccttctgctttcacctcaggccacctattagggcctctgccctcctctctggatacacggccaacttttcatgaggatcaggcaggctcaaatatattaaaatcctttgtcagacacaaaagacttcatgtctgcaaggtgcaaagtagaaagtcaggacaggcaccctccaaagagggacttggaaagaggcccacaaagaagcatgagatacatgtatatattcatgaaaaacattaaatacagtacagaatgctggaaagaacacaagtgttggaataggcctgggtttgaagtcctgttctgcccctcactagctgtatgaccttggccaagtcagaagtccatccagatgctcaatttctccatatggccgaatgtaatgactatgcccaccttgtggagggtgacctgaaacgagggttggacactgctgagcacagagctgagcacacccactctccccactctgtagtcaggggttcccagacagtgggtgagtggaccccactggtatcctggccagatcccccatgctaagcaggtcccccatcactcagctgccatgagtatctgctggtgccggctcacagctgccccatctttggacaactgcccttagctcataggagctgccttgccccaacagttatgccctcgggggactaccctgctataggagtaccgaagcctagtcaaccctgccatgccatccattctccagagctccccaggatctggctgaagttagcctgcagccaagtgcccatgtctggctgcttcttctcctgccccatgctgcgtctccctctccctctcttgcaggtttcacctgcgagcactcccacagagcacttgcacaaaaatccacttctcaggctaagacagtggaaacaggagtgaagagttctcctgattttctgtattcgttacaaaatcaagtgacttctggggaaagtccagagaagaaggtacatgttaaattctcccttgagccgggtgtggtggctcatgcctgtaatccccgccctttgggaggctgaggtgggcagatcacctgaggtcaggagttcgagaccagcctgcccaatatggtgaaactccatctctactaaaaatataaaaattagctgggcatggtggcacgcgcctgtagtcccagccactcaggaggctgaggcaggagaattacatgaacccaggaggcagaggttacagtgacctgagatcatgccactgcactctagactgggcaacagagcaagactccatctcagaaaaaaaaaaaattatcccttgctagagccacacacctgactcccctcagggcccagctgcccagtttgggggtccctctgcgaggacttagcatgcccagtagaagctgggcacaaatggtaagtttcctgaggccagatggctcgggggtggctcggccagggcttggatgggccccggaggcacctggtccagtcttggtgttgggcccaggctgatgaaagatgctgctcaagacatttgctgaggaactaattaattttcattagaggacccaattagtgagtgcagtgagtgtggtggaatatctttccacccactctcagggtgactccaggtggcgttcactagggacactgagtgctggagataaaggcagcaaacttgaggcctcaggtgccgcagggtccatgatggctacttggggtgcctcaggggacagggagagatcctgagctgtgtatccagaaacatcattgccacagacctcctgtgaggcttcaggccaattgagattgctctctgggcctcaactaagatagccacagtagatgacctcagagggactttcaactaaaataatgacagctaacactcttaagacactttcactgtgtaccaggctctctaccaatatttattcatctaatcctcttgacaccttcgaggcaggatggggctatgataagcccgttttgcgatgaggaaacaggctcagggaggttaagtgacttgctcagagtcacacagccaataagcggcagagccaagattcaaatccaggttatctggctgtggagctcgttactttcaccatgctatactgcctagtgcaacccaacttctctggaactctcacagtgcctggcacagggatgggcaccaccataagtgcttaataagaatttaaaaacaggaaaataagaaaaaactggtagcctgaaagagtgtgatggtggcttgtgggagtgggactggatagctgagtagaagggagatgccatttctttggatgtcctctggtgctgttcggcttttttacgatgtatctacattatcagcagtaataacagcataaagcattataaaagctgataacagtgcttgtaccagggatgggacatgaggatcagaagacaggggtgcccaggacacttcccccggatatttttcatgtgtttaaaatgttgtagcatctgcatatattacctaatccaaaaaaatactttaaaaattatccaagaccaatcaagcaaagatcagctagagagaaactggcaggagggggcgctctggggatgaaaaataaccatctaggggctaccgcagagtcagggggagacaaaggaggaactggagggcctgtacaagtgtcctaccttctctgggagactctgggtatatctaaaccaagcccaccagcctctcactctgcaggcagggatactgaggcccaaagagtcaaaaagtgggtgtaggagacactgagactcggcgatgaacaaagtccttctctcttcactcctcatgcagcctttcaggctccactgtgcacacagtaaacaccacatacctagaccagagcgaggaggcctgacgccagctgtgtgctgccccatcccacccttcctccacccagatgtgcacatcacatcatttttatgaagtctacaggaaaaggaaaggcggcagcttccatagcttggatgtcttctatgtgttgtacatacatcctctggaattctcacaaggtatctctaattccattttgcaaaggacaggctgaggcctagatcagttacataccacagtcatgatgcacagctagaaagggccagagatgcaaacccaggtctttgggcctcccaagtccgctcatttttactatcccaagccacccctcacagagggtatttcccatcagtttaggacaagtcccacccggaaactatttttaagtgcctttgtcttcagattctgagttgtatggggctgggtgagaatctcatcacatcaaggttggtcccctgcctccaacctgagctagaccccaatcttccctagaaaattatcagcgacccctttcttagaaacatctgaataaactgactcagtaaactcccccgggagcatttcccagcactttgccccctttacatcgatgattcctttgatttacttcttcccagtagaggtttgtcctcaaatgaacttcctggttttaacacatagccctcccttttcccaatgcagaaaagggaccatgtcctgttctctctggacgaaaaaggagctagacctgaatcctcagaattcccagagctgtctgggtccaatatcccatgcaatggtctcatggcctgatgcattgctcattttgactcacttatcctttgtacaaatgacttcctagaggctttatgagggcctacgtgttaaacctggcacaacgcaggcagcagctgagactcatttggatcatagactctgtgacagaaacaagagggcctgaagaccatacccaggactgaatttggtacccagtgtcccagcatctaagacatcaggagccaggagatatcccacgttggcaagaccccttcagttctctccagccttttcctccaacccagtggttctcaaggtagggtccctggatcagtaccatccgaatctgcatcacgtgggaacttgttagcaatgaaatcctcaagtccctcctgcccccaaactaaataaaagactctgggtgggcccagcagtctgcattaagaagccctccagaggattctgaggctcactcaagtttggcggccctgctctaacccatttaaactgacaacagccactgtgacaactgcagctgctaccaatgactgggaacctactatgtgccgagggttaaacatgcactctcatccattaatcctcatagcaaaggacaccttattccatacgtccagctctgggttaggtgtgttgtgtgcatgatgtcatttactccttactataaccctcttgagtatttactattattatgccccattttacagatgcggacattgaaccccagagggttgaagcaacttgcctacagtcatacaatttagaagtggcagtcaagatgaaaattcagatctgccggattccaaagctatgttctttctgtccgtccatggaagttccccagggtctctcacacctacatcatcagtctgggtcaggtgagattcgaagaggggtggaggcaggcagggtgagcagaaagaacccagcctggactccacagtgccttccagctacagcgtgaaaggaagctgcgttatgcatgtaaaggcacagccatctgcgcctaaggaacataaaaaacagggattcagggggcatgagttcttggcctctctctaacttcacccagctgggggccttttcttttccttcttcggacctcagttcccgcaccagataatctttatcctctacaaggctgagataatttgcccccttctctgatcttgtctctctaaccacactggtctgtcatctctagccacactggtctgctttctattccctaaaactcaaactcgcactgacctcagggcctttgcacagttattccctctgcctggaacactcttcctcctcatattcccattgctggctctttgtcagttaggctttatctcagatatcacctccttagccttccctgactaccttacttaacattatctcctagcccatcatcgttccattttcattccacttagcagaacctgaaattctttattgaattggttacctatttattgtctgtttcccccaccccagaatataactccctgagagcagaaaccatgtctgacttgttccttgatatatccctagcaccctagcacctagaacattaacactgagcagctcattaactactaactgaatgaacaaataccagaaaagaaaacctggactcagaggtcagagctctggatccttaatatgtgaccttggcaagccacttcgcctctttgagcctgtttccctacttgcttaatgaggaaatgggctagatgctctccaagggtccttccaagacttccagtcttggaaagccagacctggaagcagcccagctggtccatccagagaaggcagctggccagggtcctggcagcagctgccctctcgccacccccatccacatccctgcccagccacacagtcatctcactcccccgttgcagaaactgttaatgaagtgcgcactgctaaatgcagttacaattacgggggctaagaataaggcgctgacatcagcctcctcagtttccgagtgaatcagaaggggaggggggaggaaggaaaaaaggggaggggggatggcgctctggagctgtcaagtggaaatagcacagcgttaaatataatccagcactggcctacatcagtctggagaggcaggtgatggcttggcccccagggccagggcagacaactggattcttcaaggaggccaggcagccacggcagctgagggccaactgtgatagggatcaaccaggaaccagtggcagggaaggcactccaatgggtgggtggattgtagcagggtggtggaccctggtgggacacatcacacccaggcctttgtcacctgctgttctgacagcacaagcacagccccaggagcttacatagtcctgtcccacccaggatctcatttcatgcccagaagcagaagatggcctagagtcaaacacacctgggtttgaatcaccaccctataacctgagaaagtcatgaattcaactgctctaagctgcctggctttcctcatctgcaaaatgggtacatctgcaacagcagctaccccttcaggttgccatagaattcagtgcgatcacagaaagcaatgagcatggccaagcaagcccatcaatcattttatttttataatcctgagagatgcttgaacaaaaataattaaccctttttttccagatgaggctcaggaaggttaagagacttgcttgaggtcagagccagagcggattcaaatccaagcccaggtatctttccaatacaaaaaggcagtggaactgacgaggaatgcagaatgggagaaggtttatagtgggggagatacttcacccttttgagcacattcaccaaaagtggcacctttccagcaatttttaaaagacatgatgaaatgatggttgctacggccataaagaaaagacacagaggaggcaaagtagaaaaaagtccctcagacagacaagagggtcggctgagggtgaaggcttccttccattctcgctctcctccgcatctctcccttcacccccactcagccttcagttggaacttgctctgcctctggttctagcagggagtggggagggatgcagagccacatcctgaaagggaaacaaggtagatggacctctctcccccttcccaccaaacagaactaggtgggcctatggcagctgcaaaccgaggaagctggagccaggagtctaggggattggggatggggaagggggtgcctaagggagacagaaaataaggaaagagcactgattgcaccacagcagacctgcagaccagtgatctgtacaatggggtaaggcgtgaatcctcatgcacctgattttctaagatcattctttcaggataatttgattaaaataaagtggtctgggctgggcatggtggcgcatgcctgtaatcttagcactttgggagtccaagacgggaggatcgttgagttcaggagtttgagaccagtctgggtgacatagtgaaaccccatctctacaaaaagaaaaaaaaaagaaaattagccaggggtggtggtgcatgcctgtagtcccagccacttgggaggctgaagtgagaggatcacttgagcccgggaggtagagatggcagcgagctgagatcgcaccactgcaccccaccttgggcgacagagggagaccctgcctcaaagtaaataaataaataaataaataaagtggtttgcgtccacactctcaccccacccctctacttgaactatgggaacaactggttcaattctccatcatgcttcacttatccaaatctacaagagttctgcccagctctgaaaacattaagaaaatgggaaggggggtgtggtcaggaagaagtgagagaggaagtgtcctgccctggagggtgagggtgggagtggaggcttcaaagccgcaacttcatgcctccacgtggtcctgaccatgaaggatattttaaggcctcctccctcatccaccctgccagcctccttctagggctgaaggattcattcccaccatcttagagggaaggggtgagacagcaggacattttgtttcccagaaaaagctcaggtcaaatttcaaggacaaaagttagcacttggtctgggaaagaaaactctgccaaatggaataaagggggagggggagaactccagtgaggtcattccaggtgcctgggggtgtggagagaaatcggaactctgattctccctgccaggatctgtccggcaggatatgggtatcgccgcctcatcacccagaagtactcagaccaccccctacatttcccctctgtccaaaaatggggagcggggcgctgtggtactagtttttggatcccatccactatcccaccccgcccccagcccaacagatttggtctgagcggaagagggtggtgccaggaagggctttccagcccagagatgtggcccaaaccgctaggagagggactggtagctggctggtgttgccatggcaacctcctccctgcgctggatcgaagcttccatcctatgggcaaatcagagctggctgctccagcttctccgcccttctcccaggcgggagggggagaactggacgctgaaaccacttggtcaggctcaagaacaccaggctcaattccagaccctgatgtaacaaccccctttggcatctgttggaaacttgagacaccccagctccccagctaggccccaaggcagagtgtcagggctgggactgtagatgtgattggtgcaaatgaagtggtcaggaagagcagggaaccagtggctgaaatcctccccaccctcttgactggcaggcgagtctcccaaatccctatgtttaagccacttcaaagaaggagggcccagctctaccttaataactgtaatgatgcaataagattagcctattaaaattataaagctagcattttgagaatcagccttctcccctccccaaacccacagattcttttctacagtcatgttcagaaacaactctttctcagtaataagatagataacagctaacatgtagtgagagcctacctcatgccaggtactgtactaagacttctgcacagcacaaacagcataatggttgattaaaagcatagatgcttaagtcagattgcccaagttcaaggcttcattccctcacttcctggctgagtgaccttggatgaattaatatgtctgtgcctcagttttctcatctgaaaatggggatgttaacaggatagcagttttataggcttgctatgaggaatgagttaatatttttaaaatgcctgggaatatgtctcgcacaaaggtaatcatttgtaaaatgttaaccctatgcagtccatgttattatttttcttcttccttacagatacgaaaccgaggccacgtgtctaactcctccccgattacaaacccagtgccaacaaggctgggcaacaaaacacacacacaaaaaaacgcctccaagcacatgtttccctaaagccccagcatccttgtgaaagagggcaaaaggagcatctcaagaagtaagttcaaagtgcacgagggaagatgccccttgagaggaattctgggaaccagtaatgaccagcatcctgggcccacggcgggctagaaagaggtgtgaagaaggctcagcttcctgtgcccaccccaatggccaaggatcccaagtccaaatcaggaatgtgctctgccccagttaaggctaatgagaaaaaggctccttctcacaccatttctcaggaaactagcaaaaggatggcaactaaactctgaagatggctctggctcagtctagttggaaaaagatgcatttcaacatgagttggaagcagcaacaaaggggaggctcctagatgagccggaggcctgtcagggacacacttctgagacggagccagcagagacagacaggtattaagaaggccaggggagggaggggagaagaggcaggtagagccacgcctgtgtccagtatgggagagaccattccattgcttttagaaatcagttcagtgcagtgctgttctaaaagaataaatccaaaaaggcttcttttaggagaaaattaatgactttaaggagaacaggagaaattaagcaccaagacaacgctgcctacttctgactttcaccagacattcattatttttccggaaatgaaagttgactttctccctccccctcccaaatttgaagcatccctcaagaacagacagtgagcacaagatgcccaaaccaaactcttggtcgccagccgcacccccaggcctcctcacctgggaaacattttctacacagtaaggtctggatttcttaaaaatcctctttcagagggagggctactggtttaatggaaagagaaccataaacctgattttagtctcagctctgtggctgcctcactagatgaccttggcatatatatgtgtgtgtgtatatatatatatatacacacacacccattccagggcttcagtcacacacacacaaacactcacacaaatacacacacacccccatccatttgcgggcaaaaaggggatagacaagatgatttctaggtctcttccaagtgaaatactaaagaatttcaagaaggctgctggaaaaaacaaacatgagtggacctttaaaaatatcattaatactacttgaagttatctgttctgacttaagtgaaaccagagcaagttgcctgcagcctgcaataaccaaggtgtttgacccatgacacacagcatgactttgaagaaaaactaaaccgctcctgcctctgatgctcctacaaacccatgctcctgcccagcctggctcttgagatccaagtggactgctgaccactctactgtgttggggagccccctacttcttcccaccttgccttgtccagaataataatacaacctccctcagctacatgaaggcagaagttaaacctctgagcctcagttgtttttttctgtaaaatggtgattataaaaatggtaaaatgtctctgcagtaatcatctttacccttacccccatccccacctccaggtcaatagaaagacaggtctattggggatctgcctcacctatccccattcattcaccagtcaacaaattcttctggagaaagggcaggaagacatgcccaccacttcatcccatgatggaaccttggtggccaggttgatcagacaagggtccccaaagactaagtctaaacctgggcccaggaacttcctaaaaccgtaggctacattttgtggatggtgcatatatgcacttcgggagagatagtccatgttttcctcagagacttgaaagtgcccatgaaaccattttgctcctcaagcacatacactcctccagcacatacactcctctgttttgttcccccattgaattcaaagactctcggattttcaccttataaaacactgaactccaccctcacaccatacagagctttgcatcgatacgatgatccccatttcagagatgaggaaatccaggctcagaggtggcatgacttgcccaaggtcacagctaagaagtagagaatgaagactggaacctgattccgattcccaatctggcattctttggggaactctcacccaagccctctagctaccccacctgttggtggattcccttcctcaccccagaaccaaatccggagctctcatgttccttctgccgggtcccagggccctaaagagtaggtttccctacagctccccacccctcgctctggctgaggttgtgcgcaggcctgggaggaggaggttcaagccgctggctggtggccggcttcagcccaccaagaaaggcgactccagggacaagagcacctgaggtcaggggcacacaccagcgggcggacaagtgtagagttggcgccgccctacacctctctccgggaagagaggggaggaaaggccgtcacctggccggttcccctccgtctgccccaggcgtataagaagcaggagtctggagccccagcccatgagggaaggagaggagagataaatgggggcgctcaaggcctggggcgccgggcaggggtcttgggcagggatcctctggatgtggccaagacaaagatggagaggtaaggtctgcgcgccacctccaatggcggggggcgcgtcggagccccaggggtgggacggccaaagcccagggcttgaagagtgggcacattcaggagactcagggagggtggcaggtcggctccagggacgaggcaaggggcctccaataggcgcgggtgaggagggagatgggtcctggcgacccaaagggcccacctgcgggaaaggtgaatgcagacaatctcggggtccctgggggagaaggccagaaggtagcgcatcctggagaccctggggtcccgtgggtgcggaaggagaccctgggggcgccttcccaggggattgggggtggggaggagggcgcacgggtcggggagggggctaccggacctggatcccgggacaccccgggggtctggggggcgggccgcgcgcttacctgcgtcctcgtcgtcgaaggagttcatgcacgggaagtagatggcgagcgcctcgaaggaggcggacagactgaggcggctctgcgagcgctccatgcccgcgccggcgccgggcgcctcggccgcggcggcggcggcggcggcgggcggcttgggcagcttggccgccccattcttgacgcggagtacggcgcgcggcgtggtggcggcggcccggggccgggccgaggctccgctgcggggctggcgggcgcggcggggccggcgggcgggccaggagctggcggcgcgcggagcccgaggcgcgctgtgctgctggcggcggcggcggcggcggcggtggcggcggcggtggcggcgcagcgcgctctggtccgcggcgccccccgccggcagcgcgaggcgggcttggagcggcgccgcagccaatccgtgccgccgggggagggggcgccgctgcggggcgtgggagcccggagggcgcgggctgcggcctcttctagcagcccccgggcccggcaggtgcgcgcggggaggcaggcgccgggcgaggttgtctgggccctggtccgagggctgttcccgaccccgcctcggcccccaccctcagccggccgacttgcggagaggccggcgtccagtccctcacccagacaggcctctcccagagacactggcgcgctcggaggggatgcgctcaaagggtcccgcccaggcgggtcggcactcggcctcccacacagagaccctcggcttcacacctgcacccacagagaagctcaaacaggcacccacacctacacattcactctgcaacatgccccgcagacacccggacagatacacccacagacccaccccctcacagatgcggggacagacacgtccacggacacacgcagactcacgcagagacctgcaaacacactcagggaggtaggcaggacatccctggtgcccggcctccctcacggggagactctcagatgccacaaaaccccacgaagttcaggtaggcatacacagtctcatgcattcacacttaccaaagacaccccagaattcatacacacattcatacactcagatgaacacacaagcccagacccagcacacactctgtgtcgcctccccctgtgatcatctcagcactgtcaaacactctgactgacacggccagatgcacacaccttcaccctcagacacactagagtagcacacacacgccaagacacagccacacagactccatccctcccagtgtgggtgcatcccgacggattgactgacaccctcagactcaggtacactgagacacacttggcaggctcacactcacagactctcccattatcaccctcggcgacccgcagtcctcagacacacacgggctcagacactcacagccccaggacagagacgagcgaatcggaaacccgtgttccattccctgcatgtgacctgggacgtgagggtccctgcccacctaatcaggccccagatgtcaaacaaccttctcagctgctcgcacacctctttatgaagccatctggcgacatggaaacagttcaggcctcagaaagagacagcccagagtttgaatctcagctgtggtgctgtctttctgggtggcctatggcaaaactctttatcccatgggtcctgttcctcatctgtacaatggggacaggagccttccattttggatggttgtgaactgcctgtaagataacacaggtgtttgttttctattgctgcataacaaatgaagcagcttaaaaacaccaatctagtgatttacaatcctgtaggtcagaagtctgggcagcctgagctgggttctctgcttagggcctcacaaagtattggccagactgggctcttctctgcaggctctggagaagaatccgcttccaagatcattcaggttgttggcaggattcagttccttgtggttgcaggactgaggttcctgtttccttgctggctgtcagccagaagtcaacctcagctcctagaagtggctttctggtcctttcacctggccccttccaccttcaaggccagtttcaggatgtcaagcccttctcatccttcagtagaatctttctaccttggcttctgcttactggcctgagagattctgcttttaaaggtctcgtgtgattagatcaggtccactcgcatgatgtccctttgacatataatgtaatataatcacggtagcgattcctgatcagggtcgcagtttccacccatgctcacacaagggcgggatcacacaaggtattacataagggcaaggatcactggagttattctgacacatctgcccatcacagtgtgcaaaacacctagcacagtgctggccttcggcaggtgctcctgagccctagccccttcccagggaccagatctagactttgaggcagcctggtgtcatggttaagagtgctggtataatcatccccatcttggtcaatggcagctccatttttccacttgtttggatcagaaatgttggatacttgactccagtctcacacacaccacattcaatccatcagcaactcctgtcatttctatacacaaaatgtaaccagaaactgaccacttctctgccccaaaccctcccatctcacagtcaaagtccatgttctacaaggtcctaacttctttggctctgccacccctctgtcttcatacccaggacaccccggtggctcactcggcttcagaacatctgtactgctgttccctctgcctgaagccctctcccttgcaaagggctgtgtagctcactcacagatctctgctcaaatgtcactttccctctgaagtcttccctcaccactctttatgaagtagcaaaaacccctccctgaaatgccagatcctctctaccctgctttatttttctctgtagccctcatcaccatctgacatgtttcatatatatgtgggggggtacatgtatatatacagatacacacatatttatgtacatgtgtatatgcgtgtatgtatgtgcaaacacacatacatgtgtatatgcatgtatatgtgtatgtgtttgcatatatatatatatatacacacacatacacaacacacacatttttattcttgtttatttgtttatcgtctctttttccccttcccagagcccagaaagatgcctggcaaaaagttcgtgttctgtaaatagttgttgattgaatgaataaattctcacaccagccataggaaggagataggtatcctttgcatcctctccccatcttacagataaagaactgaggcttacgaaggggaatggacttactcaaggtcatagtgagtaggcctcttgtcaaaaatggtgggtgggggccaggtgcagtagctcatgccagtaatcctagcactttgggagggcaaggcgggtggatcacctgaggtcaggagttcgagaccaacctggccaacatgccga[142 bp omitted]actccagcctgggcaacagagcaaaaactccatctcaaaaaaaaaaaaaaaaaaaagtgggtggggaatctaacccaacataaggagatcgaagaaggcttccctgaggatgtgatgttggagctgaaaatagcacctcctatgtgcctggacttcttggtgtgatttctcctttcttggttagctcatgcctaaaattccatccatagggtttgggcctgtacacttaaatcatttaccctttgtaaatatgtaatgtttccccatgggaaatttaagtggtcagccacttacacctgggtatgaataatgcattctaagaacaagtttggggggtggagagggatgcttaagaaaatgaatgagggaagtggtggatgtggatccagagaaggaagggatgggaagtcagaaatgaacttccaggttggagttcacagtccagtgagatggaggatgccaagaaccaggcagctcagtggagtggagcggaagaagcattgcctgacttgggtttaaacgcctgtccttattttatttatgtgaccttgggtatgttccctcaaggttctcatcaaaaaatgagagtaatgggctgggcgcggaggctcacgcctgtaattccaatactttgggaggctgaggcaggaggattacttgaggtcaggaattcgagaccagcctggccaacgtggcaaaaccctgtctctactaaaaattaaaaaaattacccgggcatggtggcgcacgcctgtaaccccagctacctggaaagctgaggcacaagaattgcttgaatctgggaggtagaggttgcagtgagcagagagcacaccactgcattttagcctgggtgacggagcgagactctgtctccaaaaaaaaaaaaaaaaaaaaaaaaagggagagaataattaacacctctttgcacaattgtgatgaagattggagattggacatatacagagtgcatcgcatgtaataagtacttgatagataaatttattgcatgtaaattccaagtgctcactattgtacccagctctacaaatacagggatgaataaaacagacctggtctctgccttcatggagtttatagtttggtaacattaaacaaataattatgctaataattatttaaattatttaattactaccttatctaatagttgcataataataattttaattgcaattgtgataagtgccataaaagatatatatctatatactgtgtgtgtgtgtgtgtgtgtgtgtgtgtgtttgagtgagatagggcgagatggggtcttgctatgttgcccaggctggtcttaaactcctagcctcaagcagtcctcccgccttgacctcccgaagtgggtaggattacaggcgtgcacccccatgcccagcccagcatgcatatacgttgcagtgcatttgtgtacatgtatgtgcagcttcaagtgggtggagagtctgacccagcatgaggagagggaagaaagcttccctgaggatgtcatgttcaaaatggcacttcctatgtgcctggactcttcttggtcctgttcttggtcaaacttgttcttagaacacattttacttatttatatcggtaactaaaccaaatcactgccctcagatttgcatttgaaaataactctggggccaggcgcagtggctcatgcctgtaatcccaacactttgagaggccaaggcgggtgggtcacctgaggtcaggagtttgagaccagcttggccaacatggagaaaccctgtctatacgaaaattacaaaaattagctgggcatggtggcaggtgcctgtaatcccagctcctcgggggagctgaggcaggagaagcacttgaacccgggaggcggaagttgcagtgagccgagattgcgccactgcactccagcctgagggatacagcaagactctatctccaaaaaaataaaataaaataactccggggctgctctgagagggatggatttgagtgaattcagagagtgccttgccccttctcttcaggtaagtcctgatttgaaccaaaaatccattgcttgtttttttgcctcctagcaaaggaagatggctgagaaaggatgtcccggtggaaaggtgaagtggaggagtctgagtgacaaagggtcctatggccggataggaggccatggctgggggaggctgagacatggatgggaggtaacaaggcctcggctaaggagagggctgggcctgaaagttccagagatcacttgagcaggacttggtgacagactggatggggtgagggttgggaaggaaaaggaggaacaaagacactgccaagctctgagcatcaagagaaacagcacatacagatggagccctcctcttcagacacctttccctaagctgaagccttcaagggagtgccccttaaattttacatattttgcaagacccagctgagtggctttcagctagagaagtgacaagtggctggaatgtagttagttaaacctctagggggtcctatttgcagttttgtccaagagagaaagaccgatcttgtctgtgttctgcctgctctgtgtgtgtgtatgtatgtgtgtgtgtgcatgtgtgtgtgtaaaactcccctgctaatgtgcatgcctctgatagataagcatttctgcatatctgtgtcattgtctttgaggcaataaccttgtttctgaatgcatcctttcaaggtgcatgtcctcgtgttaaatgtgtccactctagctttgaatgtgatatgtatcctggtctttgcatgtactgatatgtgggtatgtatgtgggtgaaagacataaacagacacacacaaagacagagaaagacagtgcctgtctctgtgtgcacatgatccatgtattcccgtttccatgtggttctgtgatgtgtttgtgtcttctgttgatggtgtgtccttctgtgtgtttgccttatctctaagtgtattggtgtctatgtgtaactgagttgagttagccgtattcgagtgtcggtgtaaggtttctgtaatgcctacgcttgtgtgtgtctctttgcatcctggtcagtgtgaatgcatccctgacagtgtgtgaatgttgctttgtgtgaacttgtccatgttgactggtagcttgagaggggactcatattttcttggattaatctcagtctttaagtggctaacacatgccttagagctaatagggatagagatattaaaatctgttataaactccaaatcccctaactacttacctaaccattaatttattctttcatctacccatccatccatccatccatctctccctccctccctccctttctccctccctccctcttgatttcactggcatttagtaactatgtagttatttctcttaggcgtgagttttctcatctataaaatggagatgataatgtagctacctgatagggctggggatatggggtagaaatggaagtgggataccacatataaaatacttaacgtgttgcctaacacatagtaggtgctcactatattaacgattattgtcacatcattgtggtcactgtgattcagcaaattctcatcagcactttactaagggccacccctgagctagaagctggtgaggccctatccatagcagaggccattaagtgcctctgcctcaccttcttgtgtgacctgggacaaagcctatgccctgtctgaacccatagagtgggtagagcactcttgccccaccttcttacagagattctgggggcatctgcacttctgaacctgcaaggagctgtgcagttatgtagcaggtcaggggacattccaaagccttaaaatggcagaggcctgtcctgggtcatcaagagggtcaggcagagctgagacaaagccagaccccctggcacttcaggccaaagccagacccactggcactgacaggccaaagccagacccccggcactgacaggctttcctgtcatttctagtccttgttctctctctggggacgcacctatcgggaagccatggagcagagcttcttcacttctccaccatttgtctctcacttactatttagtgaggggcctggccttatttttaaaagaaaaagaaaaaagagaactaggtagggggtgtgatgtccacctcaataagccactactgtggacaagagacagacagagacagagaaagaaggagagaaagggtagaaagagacagaaactaagaaagagacatggaacactaacagagagacacaaagagacagggaatggaagagtcagaggcagaaacaggagagagggagggagatggttggagacaggaagagatcagaatgaagtcgggctttcttgcagacctgatttgggctgccccaatttacaaagctgtaagagccctgtagcaaggactgccactctcctcaggccaccttcatccaacacacacatgtactcatacacactcatacacacattcacacactcctaaacacactcatcctccaatgctcatatatgcatgctcacaaaatggaggaagaggcaggggcctcaaagtaggggtggattctggtcatcaagaaccccctgtgtgaccttatgcaatgccaagccacatcccatttgagtctcagtttcctcattcggaaaataagcccgcagacctcactcagtggtttcaaagctaaaggggataatggatgtaaaaaagttttagaaataatggaaaagtctggaaaaggacctttggaactaggcaagctaattatacagctcacatggaaaattgctgggaaaatgtgcagttgaggaaagtggggaaggataatgagtgatcaggagccctatcaaatcccaaaacattctaaaactacagtaagtttttttgtttggttggttttttttgttgttttgttttttttattttttagacggtgtcttgctctaatgccagctggagtgcagtgacgcgatcttggctcactgcaactgctgcctccctggttcaagtggttctgctgcctcagcctcctgagtagctgggactacaggtgcatgccaccacacccagcaaatttttgtatttttagtagagacggggtttcaccatgttggccaggatggtctcgatctcttgacctcatgatccgccagccttggcctcccaaggtgctgggattacaggcatgagccaccatgcctggcccagtaagttcttttaaaggccaaaaaaagttggattcccttcatatataaagagcacttacaaaacagtacaaaaaaggccatcactcctgtaggaaatggagaaaggctcttaacaggcaattcacaggaaaaaaaatacaaatgacatctaaaagcaaaaagttattcagtatttctcactattaacagaatgtcaattaaaacaaattatttacccatcagtctaacaaagaaattgcttgaaaataaactgtatggggaagggagtggagaaatagacacagtcacacattgttagtgggagtatatattaactgatgaaaattttggagattaatttgttagtatctatcaaaatatttaaattcacaaaccataacttaacaattcaccgtttgaacagagcaattccacttctaggaatttattctacattttacatatatacttgcacatatgcaggaagataatgtataaagaatgttttgtagcattgtttataatagcaagggattgaaaataagccaggtactcatcaaataaactatgatacatccatatagggaaattctatagtcattaaaatgaacgaggtagatgggtttgggacagatagcctagatatataatgaaataagaaagcgatgtctgaacagtatgtatagtgcactcccatctgtgtccaaaatacatatgtatgtaggtatttaaatataaatctttgaatgggcacacagatttcaggagccatacacaggaagctattaatgatgatttccttaggtacataagactgataacttctaggtagtagtcagtgtcttttgctttatgcccttctctagcatatgaattttttttttttaccatgagcatgtattgtttggaataagataattttaagtacattttttcacctaaaaaaggagttagtatccatagttagtaaataattacagtgtaaatgtgttacttgggccaggattacctacaagcttcctgttatatatgacttcagtaacatggattaggtccagaatcccccttgggaccaccctcagggtgggagcacgctttgccgccagtctcctgggaatgagaaagtaggctaggctgcccaaaataaccacctgccatttcccaagctggtcactttctctcctgagccaagggaggctctggttgggtggaaaaggtggatttgtctttccaggaaccacaacctttttctatcgcactcctcctccccctgaccaagcaaccctgacatctaaacctgtcctttgatgccacccagcccggaaggagatggctggagtctagaaacctagtgcaagattaaaatctgctctgccacaggtttatactgtgatcttggggaagccactctctccctctgggcctcagcttccccacatgtcagaagggggatgggataggatgattgctgaaagccctcccaactctgacccatttaacttaagttagatagtcatgagttcaaatctgacctctgaaagtcactagctgtgtaccattgggcaaaccacttcacctctctgagctttaatttggtcatctataaaacagagaaaataatatacttcatagagtaattgggagataaagtatataaagcattaaaattgtacatagcacatagtaacatctcaacaaatggcagccatcatcatcatccagagtcttacttggacctggcccctcagaagtagccctagtttaaggacctttcccactcatctcccaacctgtacccaacagctcttctgccctgggagggccatgtgctctgacctaggaatcaataagcataaaaccttatccttgctactgaattcatatggaatcacgcgggtgcagtggctcacgcctataatcccagcactttgagaggccaaggcaggtggatcacatgaggccaggagttcaggagcagcctggccaacatggtgaaaccctgtctctactaaaaatacaaaaattagctgggtgtggtgtcacatgcctgtaattccagccatatgggcggctgagacacgagaatcacttgaacctgggaggcgaaggttgcagtgagccgagatcgtggcactgcactccagcctgggtgacagagcaagactgtctctaaattaattaattaattaattaaatgaattcatatggaatcataggttaatgtgtggccccatccaaatcacccatgaatattataattgattaataaagactaaacctctgggatggtcaggaaaggctaatgggtgggaaggattttgggacaggggcctcttggaattcaactgggcttcatttgcaatatcttttccaggaggggtacattccctccaggtactgtgacaagcctttaagattcagggaaggtgtgcataaagagagcttttgatgctgcataaattatgttactgcgatcacctccacatggaattgtccccagtagaaaaagctggatgttcctccacgtttctctgtctccactcccacagacccatcccaacttaataccaagggagtgggctcaatctccttgctgtgccaggtacctatctttaatgctggctttagtgtcaacttaggcctcagattccccagctttacaaaagaggcaggttttttcgttttgttttttgttgttgttgtttttgacagtcttgctctgttgcccaggctggcgtgcagtggcacaatctcggctcactgcaacatctgcctcctgggctcaagcgatcctcctgcttcagccacccaagtagctgggactacaggtgtgagtcactacacccagctaatttttgtatttttagtagagacaggatggggtttcgccaagttggccaggctggtcttgaacccctgacctcgaattatccacctgcctcagcctcccaaagtgctaggattacaggcatgagccaccactcctggcctacaaatttctttttttaattagccaggcatagaggcacacatctgttaaatgctttttgtcaccaaaagcctcctaatgactagacccacctgctcacctgactatcttctggcccatgacctctttgacattctcctgcattccttcaataaaaccccctcctcgttttgtttcttgaaaccaaataaccccacacccagccagagcttttccaagcaacccctgcgtatagattttcatggcaggcatctttgattctgatttggagaagaaagtagcaggcattaggaagaaatgtagggcaggctgtggatcgtggacgaaacacatagggcagaaaggtgaggtagtggtggcatctctccagccttgtgcctctaaatcaggctgacacacaccatggagcccatggatagtattttttttttttttttttgagacagagtctcattctgtcacccaggctggagtgcagtggcacaatcttggctcactgcagcctccacctcccaggttcaagtgattgtcctgcctcagcctcacaagtagctgggattacaggcacctgccatcacacccagctaatttttgtatttttaatagaggtggggtttcactatgttggccaggctggtcttgaactccaggcctcatgtgatccacccacctcgagctcccacagtgctgggattacaggtgtgagtcactgcgcctggccaatagtaatagttagtgagcatctctgagccaggcatggttcttgagccaggcatggttctaggcccaggaactcagaaaatacccagacagacagaaatgtctgccctcatgaagcatccttacctagtaaggataaacagacaatccatttatgcctagtgttccattattggaatgctaagcttgtgggagttatttatatcctactgctcaaggtcatcaccaagatctgatttttcacacacacaaaaaattgcaacctccggcataaatgggttaagaagagaaacaagtagaaattacagtgttttagatgtaagcgctgttgggaaaagtatataaagtagaggaaaattgggaggtgtctataatgctgtgcaggatggccaagaaaggcgtcatgagatggtgacagtcaagtaaagacctgaatgggggaggattcctgcagatgtctggagaaagagtattacaggcaaagggaacaacacgttcaaaggccctgaggtgtgggagtgcccctcatatgtcagagaattggaaagcaggccagggcagtgagtgtagatgactgaagggcaggtgggaatacaagaagttagagagtaatgatggaaaggagtggaaaaatgatatagtccttcttgatttgtgcaatattcttttttttttttttttcttttttggagacagggtctcactctgtcacccaggctagagtgcagtggcgtgatcttggctcactgcagccttgacatcctgggcccaagttatcctcctcatccttgtgagtagctgggactacaggcacataccgccatgcccagctaattttttaattttttgtagagatggggtttcgccatgttgcccaggctagtctccaactcctgggcacaagcaacctgcctgcctcagcctcgtaaagtgctgggattataggcttaagccaccatgcctggccatcaatttgtgcaatattcatatgccataaatattattattttgttactgttccttaaattggtttgctttttgttcggatacatttgaaatgaaaattttatatcactactataaatgaaggacaagtatcacttgcaacaaatagaatgtaaccaaataaataaatacaacactgaaacaattattaaattatagaaagatgcggtggcctgtaggaggcttaagtctgattgacagtcttagagaagtgacaaggcatactagcacccgggtcctacttcatgtgccaaggggcaaaaaacatactagcaccaaattgggagtttctctggtatggtatttagtgttacactatagaaaatcatctcacgtcccactaggcaggatgaccaaattgttgtggtttccccaggactgaggggtttcctgggatgtacttttactgctgtaactgggtcagtcctggaaaaaccaggatggctgttcctcctatcaccagcagtccctctcccaccctgtagtctaagaccatctgccttcagcttgcccttctctacgttgccctttgtggtggctgactctaaggtgatccttacctcctggagttggtgtacctgggtcattccctccccttgaatgtaggtaggacctgaaacttgcttcttacccataaaatatggcaaaagtgatgggatgtcacttccatgattagattccacataagatggtgacttccacattgctaactcctctctttattgccttctcaccttggcaactctctattgccttcctagcttgcatgatttggtgaagcaagtagctgttctgcggggcaccaatggcaacctctggtgagcagccagctaggaagtaagacccttagttcaaaggcctctaaggaaccaactgttgccaacaactgtgtgagcttggaagcagatgcttccctcatcgagccttcagattgagacccaagccctgactgatgcattgattgcagcctcgtgagagatccgaaagtagagtgcccagctaagtctgcccatagttctgatccacagaaactgtgagataataaacgtgtgtgtgtgttttaagccatttaagtctatggccatttgatactcaggattactaatactaaaacaccctttccaaactattgcttctctgggtatattagtccgttttcatgctactgataacgacataccagagactgggtaatttatttattattaatatatatattttttgagatggagcctcactgtgtcgcaggctggagtgcagtggtggcacaatattggctcactgcaacctccacctcccagattcaagctattctcctgcctcagtctcctgagtagctgggattacaggttcgcaccactacacccagctaatttttgcatttttagtagagacagggtttcgtcatactggccaggctggactcgaactcctggcctcaagtaatctgcctgcctcagcctcccaaagtactggcattacaggcatgagccactgcacccagcctggactgggtaatttatgaagaaaaggaggtttaatggactcacagttccacgtggctggggaggcctcataattgtggcataaggtgaaaggcatgtcttacatggtggcaggcaagagagaatatgagagccaagcaaaaaaggaaatctcttattaaaccatcagatcttgtgagacttattcactaccatgagaacagcatgggggaaactgcccccatgatttaattatctctcactgggtccctcccacaacatatgggaattatgggagctacaattcaagatgagatttgggtggggacacagcaaaaccatatcactaagtcctgattatttgcacggctcatttatggaccctgatgtcttgaggctattgctcagcttcctacacctgaccctcaaggaaccctcccctatttcattctggctgcccccagctgaggtggacagtagctcaggtttcccttggtagacagagctcagtatccctacgtgaggggatcttcactccaagcccaacaaacaggagaatgatgggaaattaaggcctggagatgttggagtccaggccactgggcaagctgcctaaaggaagtagggctctagcctctggtctggggacagggacaggactctccacttttaactgctccctcctggccatgccccaaactgcagagcccgtataagtcaccattacaggccatctgttctctaggccttgcttctcactctccctgtttccaaccttcttgcccaccctgttggttttgtgcctggttctcttttcttagcctagttccatccatttgaaaaatcatctggacagctgcccagatgcccaatttgcaaatcaaaataaactaattttattacaaaaataatttttgcacattttaggaaagttagggaaaaaattaaaataatcacaaagaaaaaaattgaaaatcacataatcataccacccagaaataaccacttttaaacctgatgtatttttttgaccatatatgatatacgaatatttctaatggtattatactataagtgcttttatggcctgtgttttgtttatttttccacttagctttctatcataaacatcttctcacagcaataaaaatacctccatctcatcgttttaagtttctgaacaacagctgacataatttaactaatttctaatgttggacatttaaattgttaccagttttttgctgtcatgttaaagtttaaagaaatacttttgcaattagattgctgaacacatccatgacttcactagcaggacaactgctgggtcaaaatgttgcatggtttgaaggcttttaataagttttggcaaatttcctctaatgacattgtaccaatcttcactctccaggagcatatgacattcactctccaggagcatatgacattatttcccatcctcattctctaaaactagcaattttctttgtgattctgtttttcatggtctgccatcagcaataccataatttctttctttttttttttttggaaatggagttttgctcttgttgcccaggctggagtgcaatggcgtgatctcatcgcaaactccgcctcctgggttcaagtgattcttctacttcgatcaagactgtttttgagatttgcgttaaattatataactctattcattttaactactgttaaattttatcttcatttttaaaatttgttttcagactaatgtaacttgttgctatccttgtgctattataaacaatgagttaatgaacatcttcatccctgtatctttactagggtttctatgcagaagtggtttgctggttggtaggttaacattgtttttcaaactttttttattgtgacctatgataataagcacattttacatcacaatctccacatacacaagttaaaacaaaagtttcatgaaatagcccttatctttattactagaaatgtattctgattcaacttcctttttaaaatgtcaattacaactcacaaattgattttacaacatagtaatgggtcatggcccacaatttgaaaaatgatggattaaaatatatttggtttcactaaatgctttaaaattactctttagggtagatacactaatttacaagacaggttatcattgccctacaccctaaccaacacctgattttatatttttttctttttgccagtctgatgtgtataaagcagcatgtcattgttattttaatttttctttctttgatgctaataagttgagcttctctttatatgtttattcactaattgagtttctcagagagtgagtttgcctattttttgtattgggttgccaggtttcttcttgctgatttactgctgagtttcttatataatttagattttaaatccttttattgttattgaaaatatactgtaaatacctttcccagtctgttgatcatttgttagctttgtctgtgttgtcatttatagagcagaaaaccaccaattactttatggtttggactttttgtttcttacttaagaaatgtttccctaacccagtgtcataaagatttgcctataaacgttttagcttcttaaactagctgaagtttgttttacatgctgtgagataggatctatttttattttttccatacaaccagatattttccccaacaccattaaaataatccatcttttccttactgatttctgttgtcaattctatcacataccaaacatccacatacacagttctgtttctggattcttctcttttgtcccactagtccacatctggtagggtgatccccatctctgctcttaattttgaaaatagttcttttagctatttatggaactttattcttccatgcaaactttataatttgcttctctaattcctctcccccaaatatttggtaataattacatgaattgacaccattacactgctatttcttaccgtctacaaacagtacatttcttcatttacgcaggtcttcttttatctcctttgataggttttctctaacatgtttggttaattctagataactcattttcttaatcttctttttttctcctttaaaaaaatagtctccaatttcatagaagggaatagtatcttcttcccaaacagccaagttttattatttttttgtttgtttgtctgtttttttttgtttgttttttttttagtagagatgggggtttcaccatgttgaccaggctggtcttgaactcctgacctcaagtgatccgcctgcctcagcctcccaaagtgctggggcgtgaaccaccatgccaaacaaattattattatttttttagaactcaggatcttgctctgttgcccaagctggagtgcagtcgtgtgatcatagctcactgcagccttcaattcctggatgactcaaaggattctcccacctcagcctcccgagtagctgggactataggcatgagccatcactcctagataattgacttaaatttttttttttttttagagagagggtctcattatgttactgtggctggtctcgaactcctgggctgaagtgatcctcctgcctaagccttccaaagtgctggaattacagacgtgagccacagtgcctggctctcagccaagttttcaataccattcccttcatgacactgcctcctggatcacctctttagtaagagatgaacccagaaatccagaccctacacaaaccaaacagaaccagtaaggcactagtcagatgggcacctatagaagttgttaaagcatgttggggactctaaaagaattttagaaataaaatgacatggagaaaattatattaacctgacttattctcaaggctatgactatacgtatttgaaggtgatatagttgactcttgtactttgtcagggttaggggcaccaacccctgtgcagtcaaaaacccgaggataacttaactccccctaaacttaactaccaatagcctactgctgaccacaagccttactgagaacataaacagtcaattaacacatatttcatatgttatatgtatcacatactgtattcttacggtaagctagagagaagaaaatgagctgggcgccaaggctcatgcctgcaatcccagcactttgggaggctgaggcagaccgatcccttgagtccaggagcttgaaaccagcctgggcaacatgacaaaaccctgtctctataaaaaaaaatacaaaaacttggctgagcatgatggcgggtgcctgtagtcccagctacataggaggctgaggtgggaggattgcttgaacccagggaggtcaaggatgcagtgagcagagatcacgccactgcactcctgtctagacaacagagtgaaaccctgactcaaaaaaaaaaaaaaagagagaaaaaagaaaaccgtaagagagacaaaatatatttaccatactatacttattgaaaccataagtttatgttattgatttacaagaagaattgtctgcctgaaaaggcaagcaacctcagctgcagacctcaacctatgatacatatcaagcaattccactctttcttataatatcacaatttttctccacttcttgggagtacttcctgcattactggtagcacttgttatgggtcccatgatgtcattcaaggtttatggcattgcactaaacacagcgaaaaatacctaagaactttgtgagatcactttttactgccacaggcaatttactggagagatgaactgctcatgaagagatgattagcagcacacagcgtcttaagtggaaacttgcaacccttgcgctcacagcaatagcaacaggaggtggctacgaaattattacagtagtaccgtatgtgctatggttttttgtttgtttgtgcttttttcaagacagggtcttgctctgttgcacaggctggagtgcagtggtgtggtcatagttcactgcagccttgaattcctgggctctagtgatcctcccatctctgcctcctgagtagctaggatgatagtcatatgtcactacacttggctattttttttaactatagttaattttatgcaattatgagttaatactgcatcttcacatttgttcacatttctcttaactgtgaatggcaccatgcaccatctgtttgcgtaagttttgatgaattttaactttttataatagatgtgtgtatattttatggtggtaaatgataacaataggtaagtatttgcatattttcatacgttgatgacatatttcctttttctttttttgatatttctaaggtgtgtttcatctgcaggttttttcaaattgtcacaaatcttcaaagacatttcaatatatttattgaaaaaaatctgcacataaatagacctacacagttcaaacctgtgttgttcaggggttaagtatacttttaaaataaatacttggagtgttggagaagggaagatgatgttaaactgccttctaggaagacagctatgctttactacaggactctagtttctttaagccagtaatgcaagtttggggccagagctgaattgcttgtaatagatgatgcaaagtattgtcacaagagatcttccttcccagttgttccttcatgcatgatccagcttctcttctgaacaaatgttgagcaaatgtttatttaaaggaaaaagtgacactgatttcttagttgctctgggcatctgcatatctcaggttggcaaggggtcttggcagaagcccaaacctagatgagccataaaatcaggtagacaccaaggtgacaacttggggcagggaccaaggtcagagccctgtcacaggaactgtggaacagacttcttgaattgggtagtggtccagttattgaaacaccagcccacatcccaacagaaaaaacagtaaaatatctgtctaggcaaatttccaaatgaagaaaaacaaatagcccatatgaaaaaaagaagtgttcagcctcattagaaaataaaacaacaaaggatattttttttccttgtctgattggcaaagtttcttttttcttttccttccttccttccctccctctcttcctccctcccttcctccctccctcatttccttccctccctccttccttccttccttccttgcttccttccctccttccctccttccttccgatactcattgttgagggagtggtgaaagggtattctcaagcacagctggtagttgtgtgagctggcacggcttttctggagggcaatttggcagactgtatttaaaaattctaaagacacgcactgtttttgatcccgcaattctacttctagggatttctcctaaggaaataattagaagtgaatacaaagatgaataatagcagcttaacatttacagggtgttcactctgtgcaggcagtatgctaagcacttacacttaactcatttagcccttatagcaacatgcaatgtgaggagtattgtcaagtccatttttaggtggggaagctgagtcccaaggaggtggtgtaagttgattaagttcaagtagctagtaagtgacaggatgctcaaatcctgatctctttaactccaaaacccattctctgaaccaccttgttatcctatcctctggaacactaagtgtaaaaaagatgctctacatagtaccgtttaaaatggcaaaaattctgaaataagctaaatgtgcaagaattagggaacattaaataaatcatgtaggatcatatgataaaatacatagtcattaaaaataagttctaaaacaacgacaccaggaaatgttcatgatatatcaaatgggtaaaataatgtataagttatgtcccattttaattttaaaaatgcatatgtaccatttttatgaagtttaaaaataggaaagaccagggtgtaatgatcaaggttggaggggaaaggggtcgtcgactgggaagcctgctgggttgcatggatgtttacatacataaaaattaagccagtagtgcagttaacatttgtgtgctttatacaagtttatgtaagttatatctcactttaaaaatacataaatgcatagaaaaagccctggccagaaaaacaaaaacaaaaacaaaaaaacaacgttagcagtgattgttgctaagtataattttcattttattctttatactattctgtgtatgtgtgggctttttttattttccatttttttgttttgggggttttctttagagatggggccttgctatgttgcctaggctggactcgaactcctgggctcaagcaatcctcccgcctcagcctcctgagtagctaggattacaggcatgtaccaccatgcccggccttctgtgctttccttcccctgcatttcccacccttccaatgagcctgtattatcttattcttgggggctgggggagaacatgcacatgacggccaggctgtagtccagacctagaaccctggaggtggcagagcttttcaaggactccagtgctgggcgccaacctgagtctagtcttgcaggtacaacacagtggttccaaggatactgagaatggtgaggtccagtggccagcctgtttggaggatatgcgagtgagaatccctgagtagccttagatgaactagaagcaacacccttaagataagttcctccgactttaaaattcagctgggcaaaggctgcatgtagccatcctggccacggagccatcctggtcacagcaacaattcattgttcagctgctggttggatgccttgttgctcactggtgatgacatcaggtctccagggagcacactggctgtcaatcagaagcctttttctggcagcagtgagccatctctgcctcctctctcttttaaaggggcagcttctgcctgggcaagggagctaggtttgggccaccttgattctttctttccatttcaagtctaatttccagggcagtggagatattaaagaagagcaaggtgggttactgtgggtgtttctcaagatcccagcttcagcttactcctgacaataaaatcttgctaaccaagacatggatcaaaataaagatggagctaaaaaattaaaatccagtggatataaaaaatttcactaaatgtttttagtggatctaaaaaaattatattttaaaaatctttggtatataaaattgctggtaaatactaaacaggcttaaatataaaatgaagaaaaataactgagaattatcagttatttccatcttccttactaagaaatactaatttgattgaggccatcaaatgtgcctagttaaaaaaaaaattcctcatttcctagcttctgttgcagctaggggtggcatataacacagttatggtcaatgaaatgcagactaggaatttgcagaaaactttccttttctgatttagtcattctctcctttttcctgggtggaataagaacatgatggctggagctttagcagctgttttgcaatcaaaaggaaaatcccaggagaattacacagacccttcaaccctgacatccttgaagcagtgaaatggtgacggcaactgcctaactcttcaccacttgtttatttaagacactggctactcaggctttctgtaattcatggctaaaagcaatctttttttttttttttttttagatggagtttcgcttttgttgcccaagctggagtgcaatggtgcgatctcagctcactgcaacctatgcctcccggattcaagcaattctcctgcctcagcctcctgagtagcggggattacaggtacgcaccaccaggccccactaattttttgtatttttagtagaaatgggctttcaccatgttagccaggctggtctcaaactcctgacctcaggtgatctgctcacctcggcctcccaaagtgctgggattacaggcgtgagccaccatgcctggcagtctttaactgattcactccattgaagtaaaaataacaacacagtaaaacgggaagtttggggagaaaagatggaaagagtataacagtgccagtgttttattacatgtagtcaccatctaaaattgatatataaggctaaaaacaacaatgtctgcaacctcttaatgttttcaggagggatctttaaggggctcatatatttcttttggtggagaaattgttatctaaagttcataaattctttctttacatttgtttctaaaattccaataaattcaagtaaaataagtgaaatacccttcaaaacttaagaagagtattataatatgaaataatttttagaaattatttctgattacctatctgtatagatgcattgaaagatgtttggagtgatgttcacctcatttgaattatgctcatttccggctttttatttttgtttttaaacttttaattttgaaatgattgtagatttacagaaaagttgtaaagatgggaaagttctgatttcctcctcactcaacttcctctaatgtcaacatcttatgcaatcatgctacctgtataaaaagtaagacattaacttggtaattattatagtatgatgctgttaaccagaatacatacttcattcagattttctaatttttccactgatgtcttttttatgttccactttccaaaccagaataccacattgtgtttagatatcacatctccttcgtctcctctggcctatgacagttgcttggtttttcctttcctttcatagccttgacacttttgaaaagtggtggtcatatactttcagaatgtttctcaattttggcttgtctggtgttttctcatgatttgactaaggttttaggctttggggaagaaaaatcacagaagtgatgtcttgtcatcccattcattacatgaaagggcacgtgatctctacatgacctctcactggtgatgttgaccttgatcatttgactttttcactttattctttgtacttttttatattgctttaattccttataatgagtatgtcataaaagggaacttggaagtgctacatatgctgaagaactccacaaatgtgagggttaaatttttcatttgaaagagaggattgatgtccaaggcttggctgaaagagggaagagaagataagtatagctacgacatcaatgttaattgcctggaggccagccagggtggcagggaaaaatggagatgactttgagattatgtaactgctagcagagcaaagagtgagggcctcatacaaatatttcttaatattgatacatttccctttagcctatagccctagttgagagtgggggttaccccactggccaagttggaaatggcataacagcagagagctgattctgttgcaaaagcgagtgggcatgggaactaatgttaattaagcaccaggtatgttccaagtgcttgactaaatcatcccaaccctgcctgctaagtatgctggtcatctccattttatggggaaatggagactcagagaagtgaagtaacttgtctaaagccactcggccagttaaccatcaaatgtctatcaggcaatgtaccaggcaggcacaggaaagctactgtttgaatctagatctctgtgacactaaagccacactcttccccccaccccccacatacacacactttacaccacctgcttcccaggaagggccgcagacacgtacaggaatcccaattatggggaaagaagatgagcttctgagactattccgatccacaagatttttcaaattcttcacaatctctgtctcatggatcagagagatccatgaatccccaggtcaagatcctactaccctctgaatgatttggacagctgttctctgcaatcagatgggggaaagggcttggggtagctggaacagccttccgctatccctgctgttgacaagaccgtaggatgcagggagaaacaaagaaagagatggcgagagaggggagggaaaaagagaaggaggggagagagagaaactgcttagttttgaattcctttttccagttagccctaaggccagctcccaatccctcctaaggatggattttagcaaagaggaacccctttttattaaagctagttcaaatttggtttctgtaacttgaaaccaatgtgggcacatgggcggggccccagtatcatttactatctagtggtaaccatgtcactgctgatttttatggtgaaatgataaggtggagaagcggttcaccttcagctggtgctgttactgttgttgctgccactgccagcaacatggggcttggtggtggtggtagtgacgtgcgatggtggttgtgagtgtgacgattattggaggggctagcgattatgggtaccaaaattccttggcagagatgctggttattggaggggctaaagatcacaggtaccagcatccctatttcttcaaggtttgtctctttcttttacgctttgtatttctacaatggccctggggagtgaaaagacttagaatttcatcttgtcaagactggtagatgaaaacatgactgaagaattgatgtgcattcattccaccagttaagtcctgttgtgtgtacattttttaacaatgcttgcattccctggggctgcaatttattctacttgccatgatgtcatggttcactgtgaaacacaggagcgtgttgacttcagacttctcaacacattaaacctatgagcagagtgtaacctgccaacgttgtgcccggaagtcgtgaagacttctgggatggattcatcctgcatcaatgagggctagttgttttcagctaaagcttgtgagtatgagggcacagggaccgtgcttgtgagtaagcgggccggcatgctgctgggggtgcgtcaggtagagagactatagcgtgtgcatctgttcctctctctcaatgtctgcccgaatctccttcgccctccccagagtgaagcagtgaggcaggagcaatgctcacatttcactccaagcacctaccttgttatattttcaacaaaatagctttctacctaagaaatattctgggacaaatgtaaagcttattcatccattcaattaatatcggtgatgagccatgcactcgtctaggtgctgggggtataagagtggaaggaaggaacccacaaatccctgctcttatacagctgacattctagcgggtttaaacatgtctcattctcatcacacacaggtgaggaaactgaggttaattgacttaactgaggacaaacagtaaagggcagagctaagattttaagtaagatcagactgatccccaaacccatgcccctgaccaattctatgttatcttcagtgaatattttttaaaaatttgtactgcccaacatcttttcaccattctttgggtactagaaacctccattacttctggtaaaccactcttccagtctccaagatcatctagaaaaactccagtaaaggcatcctgtcctccttcaactgaagaacgggttcataacccaaatatgtcattccaatgctgctttctgctgtcaagacctcctggaagtatgactcttttcgctctcaagttgatttttcagctctgcctatgattctgtaagccatcccatatttttccaatacactttttttatccagttatacagagttcacttctgttgcatataaccaaagaatgaaactaacacattgtcccttcaccctctaggtcttaatttgacccaaagcaggttttgtgatctactaactagaaagtattgcacccacctcccaggaaagaaatcttgtttacttgagccaggcctgccgacatccctggcttctggccccttgttcagacctagccttccaggaaaagcttccctgctctgcaccggggctgccagacttgcagatgctgcacactcagcaaaagcagtggaggagcctgagctatatttgaacttctctgagagcacacagacacagccccctgtgctctggctggcggaggggactggtaattaacagtactcttgttcagagcacaaatggaacaggtgatggatcagcaagttcagaatcagagccacagccaatctctccatccccaagtctatttttgggtcaccacagatgcttattaacaccacatatcagggctacaggacagacaagagacttgtcttggggaacttgtcagtcaaaattacattgagttttatgtaacaagtctgaccagataccgtttttttcccctcacccaacaagaagtccagtggtaggcagtccaggcgggtatagaggctcagagaaatccttaaggattgaagctctttttatcttcctgatctgctatccttagcagctggctctcaccctcatagtcacaagatggctgccccacttccagaagtctcacctacattccaggtaggaataaaagcaaaagcaaagaagagaaggcatgttcctgatgagttttccctacccctttgtatgaggaagacaagagattccaaggaagcctcatccagattttcctgtacatctcattggtcagaactgggtcagaggaccagctgcaagggtatttttaactgggcatattgtcattcaaacaaaactgggattctgttactaagtaagaaagggagtaaaggcattggttaagtaactagtagtgtctgtcacaaaaggtaagatgggaaatgggtcatgatcgagggaggcctccaaggggcttagtcacaggttctcaggagcacacaaactggacccatttccagggtccccatgtggaaaggcagagggctggaggaaggtcttacggctgttcgcagccccgccctcgttctcatggtaacctacagagaaaaccaggagccacatgaatctatcctttatttatttatttagagatggagtctcactctgtcacccaggctggaatgcagtggcacgatctcggctcactgcaacctccgcctcctgggttcaagcgattctcatgcctcagcctcctgagtagctgggattatagacatgtgccaccatgcctggctaatttttgtatttttagtagagacagggtttcattatgttggccaggccggtcttgaactcctgacctcaggtgatctgcccgcttcagcatcccaaattgctggaattacaggcatgagccactgagcctggccaaagctgtcctttaaagatggcattgaggtcagagaaacgtgggaaaggtaaagaggttcaccaaaaaagagtcaaacagctctgatttcaaatccaagctctgccaaataccaatgctctgaccttgggtgaatcacttaacctctctaaaatgggggtaatactttgcacatgttttgtgaggctcaaaaaaacttcaggtatacattgtatatcgtagctatcccaaaaatggtcgttattattacattaattccctccttttctaaatggtgaaaatgaacccagagaggggaagcaagatgacctaagtcacacagccagatagaggcagagctgcgaccgggcccaggctatctgacttccactctgaggggtgttccctatcatcactgcctgtctctgtaacaaaatgatgaacattcattaaagtgtgaaattaggcctgaatggtagaacaaagtcgctgatttagaattttatttaaaaacacaaacctcaaatttcagacactgaagatgccaaaagtcaagcagaaaaggtagaggcatcctggtgtgcccctcctggtgaattctactcattgttactgtcatttactaagtgcaccagccgtgtgcctgacatcacgctaaagcgtctacctaatggcagtagctaacattcatggaacactatgttagtttcctgtggctgctataacaaaatcccacaaacttagtggcttaaaaacacatctttttttttttttttttttttttttttttttttttttttcagagacaggttgtcactctgttgcccaggctagaattcagtggcatgatcatagctcactgcagcctcgaactctcaggctcaagcgagcctcctgccttggcctcctgagtagctggaattacaggcatgcaccaccatatccagctaataaaaaaaatttttttttcagagatagggtgtccatgtttcccaggctggttttgaactcctgagctcaagccatcctcccacctcaacctctaaaactgctgggattacaggagtgagccaccacacccagccaaaaacacaaatttattctcttacagttctggcggtcagaattcctgagatcactgtgtcagcagggctgtgtttagtgagctcgttcccttgcttttttcagattctaaagtcacctgcattccttggcttgtggccccttctttcgtcttcaaagctggcagtgtagcatgttcaaatcaatctctccccaccacacacaaacaccctcgcctctgctttcattgtcatgtctcctcagattctaaccctcctacctccctcttccattttcaattatattgagtccaccaggataatgcccccatctcaaaatccttaattgaatcacacctactagatcctttttgccatgtaaggtaacattcacaggttctggagattgggatgtggacatctttggtagaccactagtttagctaccacaacttttatgcacctggaattgctgtgaattcatataaccctctagacaaacctaggaaatacatactgaggcgggatagataggcaaggaagtaacatgtccgcaggccacaggaaccgtggctgtgaccgtgactgtcaacacagtaagccccagcatttgcattgtagtccagctcatgcaagcaaagctatctccagtagggaatttctcctaggaagagtatgtgcattttgattttacctgtcctcagactgacccttgttcattataatagtaaaaaacacacccctgggtggagatttaagatgctactgagacatgcagtgcatgaacaagcatgtgctacccgcacatgttcacccagaggaccatccaaaacatgcttgctagtaacacctcttcctatccccttaggtaagactcccataaaggaagtttccccgcgcggaatcatccctcagggtggactgtctattctgtacctaactttcagaatattctttctcctttgcaataaattgctctgtgctgcatctcctttgctgtgtgtctcttgtttaacccactgccatttaggaaaaaaaaaaaagtgcagctggctgccagcactcatttaactttacattatcatgctctttgaggctgaagcaaatctgactgattttcaatgtgaaaataaaatataaaatctcttcttggagttatttatttcttttttctttcttttttttcttttcttttctgagacaaggtcttgctctgtcacctgtcaggctggaatgcggtgttgtgatctcagctctctgcaaactctgcctcccgggttcaagtgattctcctgcttcagcttcccgactagctggaattacaggtgcccaccaccacacctggctaattttgtatttttagtagagatggggtttcaccatgttggccagtctggtttcgaaatcctggcctcaagtgatccaccggcctcagcgtcccaaagtgctgggaatacaggcatgagccaccatgcccggagttatttatttctaaacagaacttgtctctaatcctaatgtaacagaaatgtatatgatgatcagtatttaattttttttcatgtggtgaattgcaaagcccagaacaacacaaagcagaacatcacattccacacaaaaatttcacctttctcgtcagatcttcttgccattcctgttgtgtgagcagcagactttgcagccaccaattggactctgtttccctgatgtaggtggtatgctcctggggaagtgtcttccagacaggtgaagaggtgtgacatcatcagagcacagacgacctcaaagacgttaccaccctggcttggggtgcttttccagcattcttccaatcagtgtcagtctgaaatttacatggctaatcgtgtcctcaggattgtccttctctagcaggatgtaggagttccgcactgccatgtttagaaggtggcgaaagagtttcttataccaaaccttgtgccttttgtgctcagttggataagaagagagcatctgatcaactgagtccactgttcccatattctcgttatattccacaatgacacatggcctcttagttttatttccatttctgtggtctacctcaataacagtatcgttgtggaatgttgaaaacattgtcacctccttgtcagaccattttggtgccataaattcaccacagaattaacatcatgcataggaatgctatgttttctaggatttgacattttcagtgattgagaatcactgtattttgtaaatggaaataccactactaaaaagagaatgctgtagaatgatgtctgcccgagagttatctcagggtaaatgctgcagctgcacaagtattttcagggcaaacgggaaatgggttaaatcattttattttattattaatattttttgagatggagtctcgctctgtcatccaggctggagtgc[134 bp omitted]cactgtgttggccaggctgatctcaaactcctgacctcaagtgatccacctgcctcggcctcccgtgtgagccactgcacccggctggttaaattattttaaactaagaagataagaactgaggtttcacaacagctatcaccaatactatcattttgcccattttcaattgacaagccatgttagtttcctattgctgctacaacaaattgccacaaacttagtggcttaaacaatgcaaatgtgtcatcttacagttctgctggttacaagtctacatgggcaccttgggctgcgttccttcccgggactacctgcattccttggctagtgaccttgttcatctacccagcaacaatgatcaagtctttcttatcactccaactgttcttctgtagtcgcatcttcttccctctgaatgtcctctcctgcctccctcttccacttttaaagaccttcgtgattacattgggtccacccagagagtaacacagaatactctccctgccttaaagtcaggcaattaggagggttttgtttttgtttttgttttttgagacagggtttggctctgtcatccagggtggggtacaatggcgtgatcttggctcactgcaacctccatccgcctgtaggactcaagcaagccttctacctcagcctcccaagtagctgggactacaagtgggcaccactttttttttttttttttttggtagagatgggctttcaccatgtttcccaggctggtctggaactcctgggctcaagcgatcctcctgccttaacctcccaaggcactgggattacaggagtgagccaccacgcccggcagattagcagtcttaattccatctgcagcctcaattccctttgccatgtaacctaacatattcataggtttggttttaggacatgggcatttttgggaggccatgattgtgcctaccacacaagccaaagacccagagaggctaaataatttgccacaggttatatggctagaaaacggtagagccagacttcaaaagcaggctgaccccagcactttgaatgagtgctgacccaagcactctcattgttaatcattgcactacacttccgtagctcgttttcccttctcagcaaccctactgtgaggtaggtatggttatgactgctatgtgcagtttacagttgaagacatgaagactctcagggatgatgtggcttgcccaaagttcacacaggtagtggaaagcagaggaaccaggttagtcggactcagataagagatgtacccaaagccaggcacggtggctcacacctgtaatcccagcactgtgggaggctaagatgggaggatcacttgaactctagagcttgagaccagcctgggcaacataggtagacctgtctccacagaaaactttaaaaaatagccaggcgtggtgatgtgcgcttgtagtcccagctactcaggaggctggggtgggaggattacttgagcctgggaggtcaagcctgcagtgaactataattgcagcactgcactccagcctgggtaactgagcaagaccttgtctcaaaaaacaaaaaaacaacaaaaacaaaaacaaaaaaaacaaaaacagagagagagagagagagagacagaggtacccacaatgaaaggaagacattggctactgtgagagtgagattgtcatccttaaaccaagagcatttcagctgggcgcagtggctcacgcctataatctcagcaatttgggaggccaaggtgggtgggtcacctgaggtggggaatttgaggccagcttgaccaacatggagaaacgccatatctaataaaaatacaaaattagccaggcatgatggcaggtgtctgtaatcccagctactcgggaggctgaggcaggagaatcgcttgaacccaggaggcagatgttgcggtgagccaagatcacgctattgcaccccagcctggcaaaagagcgagactccatctcaaaaaacacacacacaaacaaaaaacaaaccacaagagcatttcaaatacttttgctaaaatcaacagctcttcccttaggtatcccacagtactggactactctcatttccttcagacctcttctcaaatgtcagctactcagcgataccctgaccaccctatccaaaatagtagctctcatgccccaacccccattctcttgtctcttctcttactgcttgtcataattatgtaaattttttgtgctagaacaaatgcttcatgagagcaggggctgtgtctgttttgtacactgctgcattcccagggtctggcatccagcaggcactccataattttttagtctgaaatcaataataacttaatccaatctcaatattctcatcaatggacttgagaataagcaaatgttattaatgtatctacattagatactgggactcttggcatttcaattgaaaaaggctttcggagatatgaaggactggaccagcaagagattctccaagtttctagccttggctggtcatgaaacttttaagggaaggccaggcacagtggctcaggcctgtaaccccaggactttgggaggccaaggcaggcagatggcttgaactcaggcgttcaagaccagcctgggcaacatggtgaaaccccatctccacaaaaaaatacaaaaaattagccaggtatggtggtgcacgcctgtagtcctagctactcaagaggctgaggtgggaagatggctagagcccaggaagcagaggctgcagtgtgagtcaagatcatgccactgcaccccagcctgggtgacagagccagactgtgtctcagaaaaaaaaaaaaaattgtaagggaagcttgattaaaacaccaatacccagtgcctaccctcaaagattctcattgaattggtctgaagagtgttctgaacatcagcattttttaaggctctccaggtgatgctaatgtgcctctgtggttgccattcacagccctggacctcctaaactagaatccctgggacaaaggttttcaaccttgacagagctttggaaaatactgatgttggagtaccacctccaaagattttgatgtaattaggctggatgaggcccagggaatagatttttcattttcgttattatacttctcagctccagaatgtctatgtagcgccatacattgttttcctgatttccttgagttttttattcaagatttcctttagttctttcagcatattgaacgtagctgatttaaagtctttggctagtaaatccaatgtctgggctttctcagggacaatttatgtccatttattttgctcctttttttttttttttttttgatacagagtctcgctctgttgcccaggctggagtgcagtggtgcaatcttggctcactgcaagctccgcctcctgggttcacgccattctcctgcctcagcctcctgagtagctgggactacaggcacccgccaccgtgcccggctaattttgttgttgttgttgttgtatttttagtagagacagggtttcaccgcgttagccaggatggtctcgatctcctgacctcgtgattcgcccgcctcggcctcccaaagtgctgggattacaggtgtgagccaccatgcctggcctattttgctccttttttaactgaaaaattaaagttaactttacacttgatgggtgccaaaagtcttgcacccagatcagctgcagacaagaacagaaattttaaacaaatgagatcaaaatcctgaagcattctccacagaactgtaacagggatgaaacatttactagtataatcctgaagacaaagcacaatcaaagcaatggctaccaagagatggaagtggttcagtcaatgcaaaagcaggctggtcaagagcaaagatcatggcaactgtttttggggggatgatcattttacttgctgactttctagagagccaaaggataataacatctgcttattatgagagtattttgagaaagttagccaaagctttagcaaaacaaagcccaggaaagctcaccagagagtccttctccaccatgacaatgttcctgttcattcctctcatcaaacaaggtcaattttgcaaaagtttcaatgggaaatcattaggcatccaccttacagtcctgattcagctccttctgatgtcttttttgtttcctaatctcaaaatatctttaaaggacacccatttttctttagttaataatgtaaaaaaaagatgacattgacatggctaaatccccaggcctcagttttttagggatggactgaatggctagtatcatcacttacaaaagtgtcttgaacttgacagaacttatgttgagaaataaagtttatgttttctgtttttatctttaatttcactttgccccaaactctttgaagtccccatatacatttatctttatataagttaggtgtgtaaagttatgtctatatgcatagattgctgtctggaacgatgttcaccaaaccggtaggggcgttaagggtgatttttgctgtccttattgcacttctctaacttgcttatgatgtacacatactattttcacaaaaggaagctggacttatgggttgagaggactgattaagcacatcagttcatctcttctctctccaaatatcccattgaaatgataacacaagcattccaaaattctaatgaaaactaacaaaataataataataataataatgcctacctctcagaattgtgaattttaaaatctggcacatagtgcttgatgattattatctgcatttcccccatccacttatagtcctaaagataacattattatagatgctcttaacccttcttgtgacatgaagttctttgcagtctggtggagctcaaggatgccttcttagcataatatttttttattaataaaattatatatataggattataaaagaaatcattcgtgttaaagtacatttatcaaaatgtttaaaaagtaaatcagtcatagaataacatatgtgcttttacaagatttggaacatgtctaataatgaccatgatttcaaagttgtgatgaacgtaagtgatattttgaaataatttcaacaacagcaatgtgatggggaaaatacctgatttctattgctgatgaagtcacaggaacacgaatactactacagtctcttctttattttcataattgaagaaaatgctaagtttgagctgaactttgtgaaaataaagacaatttttctcataatccaacttcatggatgtcctaatttaataaaacaggtttccatatgtctttgccgaagtctgtttatctgtttggtctctttcttatttattacagactctcctcaaatctactattctttacattgtattagcctaagtaaaaaaataataaaaacctatgatgctccttgacagtttgcttatattgaaggatgagacttagactaaaagttattggaagctatgtgcatgtgagcagggcttattaactatgagctttgatgactattcattagtcatcagtatcaggatctttacatctttccttctgaactggtcaaattctccagaaaagactcttctagcttctttttaggagaggataatcctcccttagagagtatagtcctgggcagtgcagtttttcttttctttctttttttctttgagacgtggtctcactctgtcacccaggctggagtgcagtgatcatggctcactgcagccttgacctcccagattcaagcaatcctcccacctcagcctcctgaggtgctgggactacaggcacgtaccaccatacctgctaatagtcttttttttcaacctaggagtctcattatttgtttaggatcagcattatttgctcagagtcagcattctagagtgtaggctgggaaagaagcccgagaagcaactgggcagagcatctcaacctcccttatgtgaactttcacttaatccttctgctttcagtccgaagaccctatctttcactatgcttggtgtctctcaagccagataccccttgtcttgtagtctgcagcttgctatccaataaagtaccctctagtcgcatgtggctatttaaacttaattaaaataggccaggcctattttatacctgtgatcccagcactttgggaggccaaggtaggtggatcacttgaggtcaggagtttgagaccagcctagccaatatggtgaaaccccatctctactaaaaatataaaaattagccaggtgtggtggcgagtgcctgtaatccctgccactcgggacgctgaggcaggggaattgcttgagcacaggaggcagagtttgcagtgagccaagatcatgccacttggcactccagcctgggtgacagagcaagactccgtctcagaaataaataaataaataaatgtaattaaaataaaataaactttcagcttctcaattgcactagtcacgtttcaagtgctctatagccacacaaaggtagtggctggctactgcatcagacagtgcagaacatttccatcactgcagaaagttccattgaacggtgctgctcaagaaccgggattggcaaattttctcagtagccaggtagtaaacattcctggctttggatgccatatggtctccattgcatccactccactctgtcattgtagtatgaaaacagccacagacaatatgtggactattttcttagccagatccaacaggctggatctggcctgcggaccatagtttgctgacccctgtctgaatgtactgccttttaaaaaaatccctgtactgttattttagtggatctagggaaagcagagtctaagatacacagtttttttttttctttaacctacaagtctgattatatgttcaggacttgtctttttcctacactttaggatccacaagcacagagccctgtctttcttattcactattctccacctagtgtccagcacagtccctgacatgtaattgtcttttagtagatcatgttgaatgattaaatgctcaccaagccaccctctgtgtaatttggcttttcacttggatctgccttcaggaaagaatgtgctggttttgctgagtagatgtcagtctgcttaacaattatatttcatgttatcaatgaatacattgacattccgattttccatctcagtctcatgagcttggtaaatgtaattccacttctgagggaagacatcagctgctaaacttgtgtagaatcaaacaaatcttggttacagaagtgtgaagtcacaattgaatttgataagaagacttgtaagagacgggaaataatttggaggacataagtacctggagaattttaaatactgcactgaaattgccctctcagcaagataagcaagagaaggttatgtagaatgttaacattgctgtgactgtaatagaacaatatgccaagggcgttgttggaaattggtctggtggggcaaaagccacaggatagatgaaaactatacgtgccccagaagagtggctatcttagagcttactgactgggaggggaatgagggagccttctggaatgctgggaatgttctatattttaatctggtggcggtttcacaggtatatgcatgtgtgctatttcattctgccatgctggtaagatatggcactttatcttataactgtatgtaagctatttcttatttgtttcttaaaaaagaaaggaatcatgagggaaatgcaaatcaaaccacaatgagatatcatctcacactctttaggatggctactatcaataagtcaaaaaaaaaaaaaaaacaagtgttgtataggatgtagagaaattggatcccttgggcactgtttttgggaatgtgaaatgatgcggccactatggaaaacagaatggcagttcctcaaaaaattaaaaaaacagaattaccatatgatgcagccatttgccttctgggtatatattcaaaagaattgaaaacagagttttaaagagatatgtgtacaccaatgttcacagcaacattattcataatagccaaaagtggaagcaacccaagtgtccattgatgaataaatgaatgaacagagtgtgatacatgcatacaatggaacattcttcagtcttagaaaggaagcaaattctgacccatgctacaacgtaagtgaaccttgcagacacaatgctaagtgaaataagccagtcacaaaaagacaaataccttatgattccacttatatgaggtacctagattagtcaaattcacagaggcagaaagtataatgggggttgccaggggctgggtggagggaagaatggggagatattgtcaaataagtacagagtttcagttttgcaagactaaaagaggtttttggatggatggtggcgatggcacaatagtacgaatgcagttaataccactgaactgtacatttgaaaattgttaagatggtaagttttatgttatgagtattttaccataatttttaaaaagtaagaaataatatatatataaatttttcctgattatattacagttgttcatttttcctcatgttcagcaatatttaatgagaagacacgtggctttctgagagatactgctgtaggactacacagattgtaaatacaatctttaaaccataaaactcgtaactgtttaactagttgttataaaacatgtttgttaaagaaaactttacatggccacttgagttgtagaaagcagaggcgaccagttttgtgtggttatttttgcccaataaagaaggtgtaaatttttcactgggcagagagcattgctgaatacacagtcgtgctggggcctcccagtggttggtactatagagatggaagttgcctttgatagatctgatccagccaccatggcaagctttgtttctcccacacctgcaagattgagagctaggcttgagcaaatatgctgcattaaggaaatccaacctaagaggtatcttggaagacagacagcttcagcaggccacacttctccaccctggtgaacttctatatctgcactaaatatgtattacttctttaatgaaaaaaaaactcatacttttaatcaatcacttacatagtgcttgctatgtaccattcactgtccttagtattttataaacattaatttactggccaagcatggtggctcacacctgtaatcccagcactttgggaggccaaggaaggtggattacatgaggtcaggaatttgagaccagcctagccaacatggtgaaaccccgtcgctactaaaaatagaaaaaaaattagctgggcctggtggtgtgtgcctgtaatcccagctacttgggaggctgaagcaggagaatcgcttgaacccaggacacagaggttgcagtgggccgagatcacaccactgcactccagtctggatgacagtacgggactccgtctcaaaaacaaacaaacaaaaaaacattaatttatttaactctcataacaaccctaagaaggtacctaatattagtacctaagaggtaggcactaatagtgccatcatcatattctacaaatgaggaggttgaagcacagagtggtcaagtaaccagcccaaggaaagcttacaaatggcagagctgggacttgaacccaggcagttagcacctgtgcctgtgctgtcaacaattatgctgcctccaaatcaggcagaatgaatttcttggtgctggggggtatccaagttcattggtgctgctatagcaaaatagctgagactgggtaatttataaagaagataaatttattttttcacagttctggaggctgggaagtccaagatcaagatacagatactagcaaatttggcgtctggtaagggctgctctctgctctcatgatggcaccttctttgttgcttgagatggactctcaccctgttgcccaggctggagtgcagtggcatgatctcagctcactgcaacctccgcctcccaggttcaagtgattctcatgacatagcctctcaagtagctaggattacaggcagaggccatcacacttggctaatttttgtatttttagtagagatggggctttgctgtgttggccagactggtctcgaactcctggcctcaagtgatccgcccgcttcaccctcccaaagtgctgggattacaggtgtgagccactgcgtccggcctcatgatagcatcttcttgctgcatcttcacatggtggaagggggcaaaaaaggatgaatactgtgtcctcacatgacagaagagatggaaggtctaaaagggcctagctagttcttttataagggcactaagcccattcatgaaggtagatcccttatgtcttaatcacctcctaaagtccccacctcttcatactatcacaacaggtcttaggttccaacttataaattcaggggagacacacacactcaaaccatagcaaggagagaacaccttcatgtttcctttctcctttttctctctcctttccccacccttcttggtccttaatttcaaggaggggaaattgtgcaattttgatctagattggtcaaatcctacattataaaggatttttttcccgggacggttttgaagagagttaacaggtctatagcagtgtttttcagactttcagatcttccagatgtataatttttttctcaaaagtgttgggcaaagacttctgctgtcagtaatgatagagtaatagagaccagattgatcctcccttaaacaattaggaaaacaggcaaaatgatatgaaacaatgctttccatatactggacaacagacaatgaagactatgattcctgagagaaaaaaaatgagatgagccttaagatcaccccttcctgtgtggagacagttttcacaatgcagctcatagaagggaaactcaagcagaatggccaaagtggctagaatttacaggtaagagtgttgaagaggagtccagagttctcaacctcagagatctccaaggggccctcttgagtctttggctgtgtactgatttacacatatgtgagaaaaagtacccaaggccgggggggaatctgctggaaagcagtaggctaaagagctcatataaggtgagaaattgtttgtgattccaacagttaaaatgcagacacttcttaatatatcgggcatcaagcagagccctcataaggagactcatctcagtcatgaggctaaattagccgtagaccaaaggctattcagaacctgcctctgaaaatcttaaaagcaaggctaaaatgaacctagatgatcccatgtaatttaacagtgtcccaaaacaaagttcaatactacttaaagaaacacaataaaatccagcacccaattacaaaatttacaatatccagtgctattcaatgaactgttctccctcaaattcatatgttgaaaccaatgtgatggtaattggagatggtgtctttggggggtaactgagtcatgagggcagagacctcatgacaggattagtgcccttacaagaagaagcacgagatctttctttctctctctctctctctacccccaaccccctgcccgccaccatgtgaggatacaacagaaaggcagccacccgcaagacaggaagaaggctctcaccagaacctaaccattctggcacctgattgtagacttcccaggctctaaaatggtgagaaataaatgtctgttctttaagctatatgcagtatcacattttgtcatagcagcctgagctgactcaaacatttgcattcttggccgggcatgatggctcaagcctgtaattccagcactttgggaggctgaggcaggcggatcacttgagaccaggagtttgagaccagcctggccaacatagtgaaa[135 bp omitted]ccaatgcactccagcctgggcaacagagcgagacttgtctcaagaaaaccccacaaaaaacatttagcatcctataaaacattatcaagcatgaaaatttttactatcaattaacacaaatagacccagaaatcacagaaatgatggaattagccaacaagggtgttaacgcagctattacaaataggcttcttatacaaaatgatgtagaggaaaccatcaacatagtgaggaaagacatggaagatataagagaacaaaatgaaatttgtagagatgaaaaatataagacctgaaaagaaagatacactagataagattaacagaagattagacactgccaaataaaagattaaaaacttcaaggcatagtaatagaagagatctaaaatgaagcacagagaaaaaaagaggaaaagatgaaagagcctcagtcatctatgggatgatatcaagtggcgtaaaatacatgtaatccaaaggtcccaaaaaagtagaagagagaaagggaagggaccacaaaaatattttaagaaataatggctgaaattttcccaattttgatgaaaaatataaacccacaaatccaagaacctgaaagaactccaagtggaaaaaagcataaagaaaagtacgccaacgcatatataatcaaagtcattgaaaacaagtaataaaaagaaattcttaaaagcgtttgggctcacgcctgtaatcccagcactttgggaggccgaggcgggcggatcacgaggtcaggagatcgagaccatcccggctaaaacggtgaaaccctgtct[133 bp omitted]cactccagcctgggcgacagagcgagactccgtctcaaaaaaaaaaaaaaaaaaaaaaaaaaaaaaaagcgtttgggaaaaaaagagttgggaatcttttggagtgataggggctgttctatatcttcattgtggagcagatgtgtttatcaaaactgcatatgttaatcaaaactcataaaactgtttatttaaaaggatgaatttacttcatgtacattatacctgaagaaacttgacccaaaaaatatggaaggaggagatgggaaggagtggggagaaaagaagaaaaaagaaggagaaaggaataagtggaatgaggttgacccaacatggtcagataaggacagggaaaaaaaacagactgtttactatcatcatcataatttcattaaaaaacaagaactgtttggaaatagaaaagttggtgaaagaaaccaaggaaaaagaatcagctatctagcatttttactcttccaattattattaataaatatgctgttaggagaaattccctgttcccattaatacctgctgaaattttttatttccagcctcctcgtcagcttggaatgaatattagctaatatttgttgaatatttacatgtcagcactgttctaagcactttatttgcatcttatctcttaatccttttaacaacactaaggtagatattattgtagctgcactagaggaatgtggtttaacttttatgtaacaaagttgggaattgtttttctgttaccatggatttccaggttgaaggtcacataacctgagcatgcccagatgaaccaaacatgcaaccacagggggaccataagccctgggaccaaggaacagtgactgaattaagaagctcgggagttcttgaccagcctgggcaacagaataagacttcatctctaccaaaaaatattttgaagaagaagaaggaagaggaagaggaggaggaggaggagaagaagaggaagaagaagaaaagaagaagaagaagaagaagaagaagaagaagaagaagaagaagaagaagaagaagaagaagaagaagaggaagaagaagaaggaggaggaggaggagaagaagaaggggagggggagggggaatgggaagaggaagaggaagaggaagcagctctgaggtgaatgcaggatccaatcagactgtgctctggcatcaccccatgacaggatccagtcagattgggcctcactgcatcacctcattgcaaggtccaatcagatcacttctctttaccctgtgcttataaaacccgatccagctcccagctcagggagacagatttgagcatttcctcctgtctccttgtcacttggctcacaataaacctttctcactgcaaaaacccagtgcttcagagtttggcttcccgttgtgcaggggcaaaccaacctagtttgtttcagtaacgttattgtccccctatcatagacatgaaaactgagacttcgagtgaataagtaaattgcgttgaggtcccacagagagaaggtggcagagccatgtttagaacccaggcagtcgggctttagccatcattctgtgcacaagtgtttcctgggtaaggctcaccgtggggatggctccacaacgttcaccacccccataagattcctagggagttgcttgtgaattggcagaattgatcttgtcaaatacaatgtctggagaaaatgtttctctatctcccaatccgtcccatatcagatcctatgactataggttctctgataattattatattctccgtttttatgccacaaatccaccagaagtaaaataaatacgtgaaagtgatttgagggtactatgagctatacacagctaataaacatgtactaagcacctacaatctgccatgaactttcagctatagttttgctcccaatttacagctgctgaaactggggcctcaagaggataaatgacttgctatatgattccatttatataaagttttaaaaacaggtgaaactaattgacagtgttaaaacaaggctgagtaatctttggggagaaggaatgtgtagtgactgggaagaagcacagggggccaaccagttgttggtaataatgtgtttctggacatgggtggtgtttatctgagtgtatgagaaaaagacagaaatgggccaggccggtggctcatgcctgtaatcccagcactttgggaggctgagacgggcagatcacctgaggtagggagtttgagaccagcctgaccaacatggagaaacaccgtctctactaaaaatataaaattagccgggcgtggtggcgcatgcctgtaatcccagctactcgggaggttgaggcaggagaatcgcttgaacccgggaggcagaggttgcagtgagctgagatcgcgccactgcactccggcctgggcaacaagagcgaaactccatctca[137 bp omitted]ctgcactccagcctgggcaacaaagtgagaccttgtctctaaaaaataaatacttaaataataaacaaaaatggaaaagacagagaaaatatgaggaaaaagagattctgtcaaacataatctattataaagattctaaaagttttccactgatgtttaaaaaatattcatctatgaaggaaagagaatcagaccagtatcagatttctcatcagaagccaaaagccagacatcaatagtgcattatcttgaaagttttggaagagatttttaagctggaattctagtctcagccaaacataatcaaatgtgagggcaaagtaaaggcattttcagacttgccaggacagaggaagtttgggtttttgtagtctgtttatttaaagtaagaagaaaacactaaagtcttggttatagttgtaggacagaacataatgttaactatatcagtcagaagatacttggataatgcttggttgagttccataaactttattatgctgttgtagtaaataaatccaaactgtcagaggcttaagacaacaaaggtttatgtctttgacatactacacattgacaatacagtggcagggggctctgttctcctgaggatggctcagaggctctaccatagggaatgctgtaaggtatgacaccaggggagaaggaaatgtgtgtgtgtgtgtgtgtatgtgtgtgtgtgtgtgtggtggtggtgctcacaccagctatcaaatgttccagcccagaagtaacaaagatcacttcctctcacaactcattggccataactagtcacatggttacactcaactaaaaagggtggagaaatgtaattctcagtatatccaaaggaaatgagaactgggtaggggtagggagaaacctttgaggtctcgtccccattaaaaaatgacaatttataaacaaaagtgaggctgacaaaaaaatggaaacgggaagcagagaggaaagatggagagaaaagtaaaccatcttagaaaacaggattttattttatttatttatttgtttgtttgtttgttttgagacagggtctcgttctgtcgcccaggctggagtgcagtggcgtgatctcggctcactacaacttctgcctcccaggttcaggcgatcctcctgcctcagcgtcccaagtagctgggactataggcctgccccaccacacctggctaattttttgtatttttagtagagacagggtttcaccatgttggccaggctggtctcgaacccctgacctcaagtgatccacctgcctcagcctcccaaagtgctgggattacaggcgtgagccaaggcgcgcggccagaaagcagaatgttaagaggtgttgtccatgtgacgaaataagaaaataggagttatattaattgaatttatgaggagaaatgagagaactgcaaataagcatataaatgtcaaacaattggaggtggagagagcagagattgcaagtagactacagggaatggtccatttgcccagacattcatcctagtctgttcacgctgtgctatagtttggacatggtttctttgactcctccaaatctcaggctgaaatgtaatccccagtgttggagggatgctaatggaagttgtttgggttatgggtaggatctctcatgaatggcttggtgttgtcctagtgattgataatgagggcgttcttgctctattagttccctggttgttaaaaacagcctgtgaacctccccctctcttggttcatttctctccatatgatctctgcacacaccagctcccctttgccctctgccatgaatggaagcagcctgaagacctcaccagaaacagttactggtgccatgcttctcgggcagcctgcagaaccatgagccaaaataaacccagctccgagtattcttttacagcaacacagacagactaagacaggctgctataacaaaatatcataaactgggtggcttctaaacaatagaaatttatttctcacagttctggaggctgagaagtccaagatcaagatgcttgcagattcggtgtgtggtgagggtctctttctggttcatagacagcaccttcttgctatatcttcacatggtgaaaggtcaagaggtctcactcaggcctcttttataaagccactgatcccattatcacctcccaaaagcctcaccttctaataccatcaccttggaggctaggatttcaacatatgaattttaaggagacacaaacattcagaccgtggcactgttgtttatatttagggagaaaatgattaaaagaggtgatctccagggagtggtactgaagttggaaaataatgtggtctttatttatttatttatttatttttgagacagtctcactctcttgcccaggctggagtgcagtggcacgatctcagctcactgcaacctccacctcccaggctcaagcgattttcctgcctcagcctccccaggagctgggcttacaggaatgcaccaccacacccagctaattttgtatttttagtagagacgaggtttcgacatgttggtcaggctggtctcaaactcctgacctctgcctcggcctcccaaagtgctgggattatgggagtgagctaccgcgcctgacctcaaatagtgtagtctgaggtcatacatataagcttttacattgggcaaattgccaggcgcactggctcacacctgtaatcccagcgctttgggaggccaaggccggcggatcacctgaggtcaggagttcgagaccagcctaaccaacatggtgaaacccatctttattaaaaatacaaaaattagctgggtgtggtggcaggcgcctgtaattccagctactcggaaggctgaggcaggagaattgcttgaatccaggaggtgaagattgcagtgggccaagaccatgccattgcactccagactgggtgacagagcaagattccatctcaaaaaaaaattgccattgcttaactcccctgaacttcagcctcctcttctataaggtgggaaggtagggtgacactctccacttcctggacttgtctgaggattaagtgaaattatgcatggctagagtttggcagagcagctggcacatggctagatgtactggctagagggacaaggcccaaactgacgttaggtccagatccaagtcccgatggaagagcagagacctcagattcttggagaccatccaacctactgctttctcggccatcgagcacatggggcccagtcttatccacagcaacacaatgaatcagtctgcaaacccaggactagaactggctcctgacacccagccctgctggacacccctgccacctctgaatcatcgactacatttggctttggacatggagaaaagggagcaatttgggaagaatgaaaacatttcctcctgtgcaaattgtttctttttgtgctggcaagtccaaggtgttctgacaaaggtcaaaagtatttattttcttgaatatcatgggagtgagaatgtgacacagatgagggggagtgagggggaggaaaggaggggggggagggctgttgccaacttcaatagctgaaagggcttctttttattacaggaagtgtttggtttgggggcacagaaacaacctctagttttctatcaaaaggagcagaaattacaattaggaaaatcacagtttataaacagactgacaattctgtcaaggctgtgctccatgctgccctgcccgcctccccagctcagatccggttcctcacccccatctgagctttgccagcccactgggtcctgacccactgcactcccctatgctgttcctctgactacactgcccgaccccagtgccaactcaggcactgttcttgacctacctgagtcctcctctaggcctcctcctcaaaaaccctccagctcttcttctgtgtacatcacaccacatctttctgtctttgcacttaccaagctgcatctcaattgcccctacacccatctgtccctcccagtggactgcagaacatatactggaccctcagactcaggtctggcattcagacagaatcctgctttttttggcctgctccatttggggccacatggtgtttttgagctgtttgcgttcatctccagaaactaaaaattaagagatttcacattaaaatccagatttttggcttctctcaataaactggaaatccagcaacatgggtccagccctcccagcagcggtcccttttggatacccatgccttttctgtttcttcacagtccctaccacgccctactgtctccctgacattaaagccttatgtcaggaaccatttgtcattattcttgcaaaatatttctttcttacagtggattaataagaaagtgaagtatttcttttactcatgttccttcctcacacctggctcacttcccttgtttatgttaccagactggaacccataagtacctgggctttcaacccttgcaccaggctgaaaacttcttgaaaacatatacaggctaagtgtagtggctcacacctataatcccagaacttagaaagactgaggtggaagatcacttgagcccaggagttcgacaccaccctgggcaacatagtgagacctcatctctactaaaaataaaaaaaataaataaaaaaaattagctgggcatggcacccacctgtggtcccagctacctgggagggtgaggtaggaggattgcttgagtaagggaggttgaggttgcagtgagtcatgatcgctcctctgcatccagcctgggtgatacagccagaccctgtatcaaaaaaaaaaaaaaaatgaaaaaagatacagtgcttcgtaacatctctgtagctccaacagccagcacagtgcatagctcagagtaggtctctcgtaatgaatataactcttgctactagaagaagagagcctctttataaattctttcatcttcttcatcatccattctaaggcaggaaattaaagaaagaaagaaaaataaaattaaaaagagaaataagctttcctgtattaggctgacttgtcccagaggcagcaacgggcatagcccagacccagggaaagtcttgataatactatctaagaaggcaggacacaaaggaatgtgctctggagactctcccagcactccctcaacacagggagaagaaaaacaaattttcctttgttttatggtatgagtttatagattcttgttctctgtaactggtgacttaaagtattctgttttatctaagcagtggtgtgaaggtcacaagctgtctgagcaggccacctgggcccatagtgcaggccatggaataagccatgctaggcactaggcaaacctagataatggacatctgggttgcatagcaacggtcatgtgtaaccctgagttatgaacctgttacaatttgattaactgtctttgtcctgcctctgtatccctgctttcacactgctgtaagcctgcttcaagttagcccacccctttttaaagtgtgcataaaagccaagtgctgtctttgttcttggcccagtctttggatgttaagtcggctgggtctgagtgcactcaataaagatatcctcctgcatacactccaaggtctccctctggtccttctgattccacaacaattcaacaacgattttctgagttcacctataagcctattttccttcctcagtgttctttctctttgatgtcctggtacctcttgtaaaccctaaatactcaaaacccctccttagattgcccttttacgtacctcttgcaaaactttgatgttagcaattacataagagaagatcataaaaaccattaattagtagtgagagtattaatgtcagtaataagtagatattaatgttatttactgagagtttcccatgtatatcagtttgttctcacaatgctaataaagacatgccagagtctggataatttataaagggaagaggtttaattgactcacagttccacatggctagggaggcctcacaatcatggcagaaggtaaatgaggagcagcaaagtcacgtcttacatggtagcaggcaagagggcatgtgcagggaactcccctttataaaaccatcagatctcatgagacttattcactatcatgagaacagcatggaaaaaacccacccgcatgattcaattacttcccactgggtccctcccacaacatgtgggaattacgggagctacaattcaagatgagatttgggtggggacacagccaagccatatcaccatgtaccaagaactttacatagatttcctcactccagctttacaaccctgtgtatcattagtcttcatattagtcaggactgtaagttgcaagtagaaaaaaagtaacaaccaactctcaaatggtttaagccaaaaggttcatataactgaaaaatcagatctagtattcatgaaatcattatgtggatgacataattctaagaattttacatgtattaattcttttaatcctgtgaataatattttaagaaaggtactaatataatttccattttgcagacagggaaacttgagtactgagagttcacaattttacatctgaacccactttctgtgtgtaagggaattacctacttcattcaactccttggaacccagagttcaattctgcagaggaagcagaaaatgccatgtcctccctgcatggaggacatcagtgttgtgacttaggcgttgcccatcaggtgcatctgccatggacttcgattttcaaactcatatagagactgttctctggcaggtgtgatgagagagtaagatccagttccagagatgacaatccagtggggttacgggcagcactggctgtctggaaccagagggccagtagtgtccccaggccaattctgttgatgtgaatggagacaccatgcctggcttctcaacctctgagtttggttcccctgtgattctataatctactccatatgcattcaacaaaactcgtgtgagtcaatattccataataaactcccttacatatatacatctatcctattagttctgtccctctagagaaccctaatacactatctcataaaataaattaaaaattaaagaggaagaaactgaggatcaaagaagttaagtaatttctttagagtcccacagccacggaatagagaagttagaatttgaatggctcaaattttgttttacttttgttatttttttgttattgcttttctcatttggcttgcaataatgttcttaattttgctttttcccactttcctgatttaaatgctccctataaaaatttaaatatataaagttataaggaagaaagtaacattctttgaaatctcatcagcatataataactactgttaatattttactgggcatctttcatgcctgtcttaacgcgtatgggcaatagaagtaacctttttcataaatcataacaaataatacacattcttttaatcaagagcaccctttttaagtgtgatttttttttcttatctatccttttcttcttccttttctgacctccattaatctcccttacttactccacactttctggctcacgataacccctgttaacaactgatgtgtacacttgcagaattttctccaagccaatataattatacatttctttatagaagtcctgtttttaactcttgcaatattcatattaaaggacactaatgggctgtgcgcagtggctcgtgcctgtaatctcagcactttgggaggccgagacgggaggatcatttgaggtcaggagttcgagaccagtctggccaacatggtgaagtctcatctctacaaaaatatataaaacttagcctggcacggtggcatgcacctgtggtcccagctgctcaggaggctgatgctggagaattgattgaacccaggaggcagaggttgcagtgagcccagatcgcgccactgcactccagtctagatgacagagtgggaccctgcctcaaaaaaaaaaaaaaaaagaaaagaaaagaaaagaaaagaaaagaaaagaaataaaggacaccagtggtggcatttggggcaccagacagtaactgttgaaagagatttcagccatagaaggagcccttcttgacacccctaaaattgcactgctgaggtgattgtcacgtgagctcaccccgtcacagttctggagtgagcgtgagaaggctgagggtgagcacctctgtccccaccaaagaaatggatcgccaggccctggtctcgtggtttccaggtttgcttgcaggcctgcctgcgaagctcaaggaactgcagagtcacttctgtctggagctcctgaatgcagtccagctaaccttccctacccggaagcccttcaacatcttttctccattccctttacgggttttattcttcttttgcctgctcagcaattttcaccagtccaaggaccgaatgctctgctctcagatcaatagcccttgggaagtactgcagacagtctctgagatgcaccctagctgctcctgcaaaggaattgctttctttctgactcagtttcacttgaattaagcttcttctgctttatgaaagcagcctccttccagagcacaagttgacatcaacccagaaccagaaagaaatcagtggctggaacttgtcttattcatctctggaaagtccagctctccagcagaggcttagaattctatttccttttttgtttcttagtcattgcgcttgagaaggcatttaaagatgctctttggctagagtaagtgctcagtaagcatttgttggcgaagggataaaacagtaaagatggaataatcagcatttggtaaatggttggtgaaggagaatcaaatgagataacacatgtgaaattgatatgtaatctgtgaatagtgaaaattgttcctggccaggcgtagtggctcacacctgtaatcccagcactttgggaggccgaggtaggcggatcacttgaggccaggagttcaagaccagcctggccaacatggtgaaccccccccctattaaaaatacaaaaatgagccaggcgtggtggcacatgactgtaatcccagctacttggggggctgaggcaggagaatccctcaaacctgggagacggaggttgcagtgagccgagatcgtgccattgcactccagcctgggcgacagagcgagactccatctcaaaaaaaaagaaaaagaaaaagaaaaagaaaaagaaaaccaaagggactcgtccgcagcgttatctgctggcgccatcttccggaaataagttagcacaacaggtctatttctgtttcagcggggcgtgagggcactggaaatgcaggcaaggaggggaaaagagagaatgaattttagcaaaatctctccatctcctctgtcctggatcatctaattactctaccaagattatcattttaatgtaatagtactactaacatgctagcacttgttttgagcacctagtacgtaccagatactgtgctcagtgttttacatgtgttatttcatcctcacagtaactgcaagaagtgtatatagtaagtcctcacttaacttcttcgatgggttcttggaaactgcgactttaagcaaaatgatgtgcagcacgtcctcaagtaatgtccttccattatgattatgagggaaaaaatggtttcatcatacatcatttcacttaaagttgcagtttccaagaaactatcaacattcagttgatattaaaaacccgaggcatacaaggtgtatagtggacttatcatctctaggattacatatctagttggtgtttgggataagactgaaacccagttctgtctgacttcagagcctgtggtgggctgttgtgagtcaggtcccgaggaatcagactccaatatggagatttgaagtcaggaagtctattgcagagtgctgtcgggattacatctgtggaaaggaaaagtcaaactgcagtgcaacctcagcagaggccttggctaatgccatggggaatatagagctgggatggcaagaggacaggaccttggaatgtccacctcgaacagtcatagggactcagctgagagctgccagcagccaatgctcccagcagctgggggaataaatgccccatcctggggatgggggtctgggtggcacaccacagtatgcactgcagcgcccactacctattccccatgcattgctcctcaaataagggagatggctgggagggagacaacatcagtgatggggtagtggaggaggaattcagagagtaaaaatggttttgtctgtcttccatccacctgtgacctaggctatgcatgccatccagctgcaataaccaatacatttgggtcattcatgttgatataatgtatggattattttatgggttgcaagccattaacaaataaataaaatgcaatattccactggctgattggagatgcattctttgacattctcaaataagaaatggaagaattggccaggcacagtggctcacgcctgtaatcctaaccctttgggagtccaaggctgggggatcacttgaggtcaggtgtttgaaaccagcctggccaacatgatgaaaccc[140 bp omitted]cactccagcctgggcgatagagtgagattccatctgaaaaataaaaataaaaataaaataaaaaggagatggtgccttctgccctggggttaaaaaaattaaaaaattaaattaaaaagagatggatctatttgtataatatggaaagacctctaagacatatttttgcatgaagaaataagattcagtaccctaataaactatataaaaattatatctatttctagagttttacatacactataaaaggatggaattttaccgacttgccctatggaaggattctacatccccaccccacgtaagtcaggcatagccatatgatttgctttggccaagggaatttgagtggaagtgacatgtgagacatccaagcagaagctttaagaggctcccccattctctcttttccttattccatgagatcagcatgttccagctgcttcttccagctgtgtccagagatacagctgaattcaacccatcacaaacatgcaattaagatataaatttttaggctgggcgcagtggctcacgcctgtaatcccagcactctgggaggctgaggcagatggattgcttgagctggggagttcgagaccagcctgagcaacatggtaaaaccctgtctccacaaaaaccacaaaaaattagctgggccttgtggcacacatctgtagtcccagctacttgggaggctgagatgagaggatcacctgagcccaggaggtcgaggctacggtgagccatgatcatgccactgcactacagcctgggagacagagtgagaccctgtctcaacaaaaaaacaaacaaacaaaagacataaacttttattaatataagacactgagactttgaggatgttgttattgtaggttattgtagcataacctaacctaccatcactgataatacatgttgctatatataactgatatgtggttacttctggggaggagaaatggcattgggaggtggcgatcatagggaattttagtttttaatctttaatattttagttttcttacaataaaaatatatccacacattactatgtaataaatatacattattttaaaatgaatacagcaggtatttccctacttaaaattaaatgccaaaaaatatcttttttttttagaccgagtctcgctctgttgcccaggctggagtgcaatggcataatctcggctcactgcaacctccgcctcccgggttcaagccattctcctgcctcagcctcctgactagctgggattacaggcgctggccaccatgcccagctaatttttgtatttttagtagagacggggtttcaccatgttggacaggctgatctcaaactcctgacctcagatgatccacccacctcggcctcccaaagcgctgggattacagacatgagccactgaggagctctatttctgattaaacctatagacctctctgagttaggatctcagcccttgttccattaaaatgaaaagccaaaattggttgcatgtatagcaaagaccttgaaatatcatagactgccttgcaatttcaacttctcattcaagccaaacaacagccctctttatctttgaagtttacttttgagcaaaatcaaagtggctagactccctgatccactgcctagtccccagcttcatgtgtgtcagatagttacagtgaccagagcaagagtagcagcagcacctctggcctctcaatcacatctatggtgactttgaaacaaaagcctcctggacttctgcaactcctgctcttctcatgaatttgtaaccacctaattccctatagtcaatccctttctgcctacaatacctagagtggtttctgttcctatctcctgcacagaggcatgacttagtacaggttggaagataatattcagaaaagagacacaaagacaaaaagatgaaaaattggaaagaaaaagaaaaaaaaacagtaaaattagaaagccatttcaagaggtcaaacacctgaaaaattagagttctggaaagtgaagatatagaaaatggggagaggaaggaagaaaatattcaaagaaataattcatgaaaattattccagaactgaagaaagtatattttcagattgggagagatcattgaggaacaattagatgttatgtgcctcctgagatgacgccatagaaaatacaagtcctgtctataaaatatgattgccaaaaactgaactgaaatctaatcaggcctctagattgaactaccagtttacaggacattggagggatggtgtcacattttaaaacaacatgaagggccgtgcgcggtggctcacgtctgtaatcctagcactttgggaggccaaggcaggcagattatctgacctcgggagttcgagaccagcctgggcaatgtggcaaaaccccttctctactaaaagtacaaaaattagccgggtgtggtggcacatgcctgtagtcccatctacccaggaggctgaggcaggagaatcacttgagcccaggaggcggaggttacagtaagctgagatcgctgcactgcactccagcctgggcgacagagcaagactccatctcaaaaaaaaaaaaaaaaagaaagaaagaaagaaagaaatgaaatctgagcaataacttccatgagcttgaaggtagattcagctccatgacctccagaaaggaatgcagcccagctgacaacttaatttttgctttgtgagactctaagtggcggatcccagcagacacacactatactcagtcttcttacctacagaattgtgagataagaagtgggttctgtttaagctactaaatttgtagtaatttgttacagcagcaatagagaacaatcattagcaaccagaatatagaaaacttggcaaacaaacaagaaacaaaaactttgttaatattagggaaaacaagaagttctataataaagggaaagccatcatggaatacagctgggcaaggctgacaatagtgtatttatggtcacaaaactgtaaacactgaatacaaatttaactaaaattatgatataatcattttgacatgatgcatgggggcctggagcagtggctcacgcctataatcccagcactttaggaggctgggcaggtggatcacttgagcccagtagttcaagaccagcctgggcaacatggtgaaaccccgttactacaaaaattagctggacacagtggtgcacacgtgtagtcccagttacaggggcactgaggtgggaggattgattgagaccaggaggttgaggctgcatgagctgagatcatgccacactgcacttcagcataggtgacagagaccctgtctcaaaaacaaaaacaaaaaaaaaaaaaaaggaaaagaaagaaaaaaaggatgcatagggagggacagaacatgacatttacctgtgggatttggaggatttggagaagatgctgcatagggtgtatgagaaagagacagtctttatattccataaaaattacccaatagatattgctaaaagtaagaaaattagggaattacaaattaagtgcataattttggtagcaaaaggtggttgctcatagaagcaggatatagggaaaggtgttaaagacttttaaggccgggcgcggtggctcacacctgtaatcccagcactttgggaggccaaggtgggcagatcatctgaggtcaggagttcgagaccagcctgaccaacatggagaaaccccgtctctactaaaaatacaaaattagccaggcatgatggcgggtgcctgtaatcccagctactcaggaggctgaggcagaagaatcacttgaacccgggaggcggaggttgcagtgagccgagatcacaccattgcactccagcctgggcaaaaagagcaaaactccgtcacgaaaaaaaaaaaaagagacttttaaaacacacacatatagcaggtcttgaagaactattttcctctatcaactattcaactacgtgcaggtttagtcttaagtaagaataaaatctaattttaaagcaattgttaactccaggggaaaaaaattccaagtaatatataaacaaattgaaagaatgctgcagtggtatatgtgtaaagtgattttagagagcaaaattgattggtccatagtaggaagtcaacagaaacttatccaaaattgagaatttaagaaggaattgtggggtttttttttcttttttttttttttgagacaagagttttgctcttgtggcccaggctggagtgccatggcatgaccttggctcacagcaacctctgcctcctgggttcaagcggttttcctgcctcagcctcctgtagtcccaactgtcattttttttttaagaaataaacaaagaaacagctgtttatgttatttagaaatatggaggcacatagcagaaggaacagctaaatgagttgaaatcaccacctcttgggagaggttagcaaaaggatgatgggtgcgggagtgccctttttcataatgaaaacaaaattatctggcttttgaaattatgcatagtgttacctagacaaaaataagaatttacattgcattgctctgagatgttcttgattttataagatgttttgtgtatatatatatatatatagtttcatgtatttctaaggatgtgggtgggaggagggatgctgccaattaaaccatgacatgccactgatggtaaaacacatgatttcagatatgttaaaatatgagaatatgtatatctttgaatctgtgaaatacagtacttttttaaaatagatttttttttttgaggcaaggtcttggtctgtcacccaggctagagtgcagtggcatgatccatagcccactgcgacctcaaactcttaggctcaagtgatcctcagaaaattgaggtcatagggtacacggccagcctgaaaactagacaggacaatacacagaatcacagtttaccaggagcagaagcagctggaaacaataactggtgggaacatttaaacagtaattatgaattgctggaggctgactgtggactagcttgagggtttaaaaaacccaggtgcccgttcttggggggctagggggcagaggtatatttttgtgagtttggcctcccagagtcccaccagtttctcacagtgaagatctgaacaaaatcccctcacactttggacaggagtagggtaaataaaccatgtggaaataagcccagagtgctctgttctctgtagcaaaggcctgccctcaatggatactactttaccagcatcttactagcctagaggaagggcaattagacaactacagcctcctttagctttcccatctcatgtagggggagaaaaaaaaagcaaagaaattcttctggaggttatagcccagggactcgggcccgttaaaaaaaaaaccaaaagctgggagtggtggctcacgcctgtaatcccaacactttgggaggacaaggcaggcagatcacaaggtcaagagatcgagaccatcctggccaacatggtgaaaccccatctctactaaaaatacaaaaattagctggacatggtggcatgtgcctacagtcccagctagtcggaaggctgaggcaggagaatcacttgaacccgggaggtggaagttgcagtgagctgagatcgtgccactgcactccagcctggcaacagagcgagactccgtctcaaaataaataaataaataaataaataaataaccaaaaatggagatttaattataagtttaagctttcccctcaccaatacctcaccagcacagcaacagagctccatgtaaaaacagtggattacaactgaaagagctgcaagacacaaaccagaattaccaagtttccagagaaactgcaagacaccaagggagacaaaaacaagaacatttgaggaaattgaagtctctgacacttacagctacagcaaacagtaaacacaacctaactcctagacagacaaaaaaaccactaaagcccaatttacctccgttactattacctgatacatcatgcctgactgtcaacaaaatttatgacacattaacagcaagaaaaaacacagtatgaagagacaaagccagtggcagaaattttggaattattggatcagaaatttaaaattactgtgattagtgtgctaaggtctctaatggaaaaagtagacaacaggccgggtgcagtggctcacgcctgtaatcccagcactttgggaggctgaggcgggtggatcacctgaagtcaggagtttgagaccagcctggcctacatggtgaaaccccatctctactaaaaatacaaaattagccaggcatagctctattaattttagccaaagcggacttcagaataagggaaatgtcagggataaagatgagcattacataatgattaagggtgagatctccatgaagacccaacaatccttaatgagtacgtgccttacaacaacagaccatcaaaatatgtcaggcaaaacatacagaactgcaaggagaaatagggaaatccattattattattattattattattattattattattattatctttgagacagagtctggctctgtcgcccaggctggagtgcagtggcgcgaactcggctcactgcaagctccacctccccaggttcatgccattctcctgtctcagcctccagagtagctgggactacaggtgcccgccaccatgcctggctaatttttgtatttttagtagagatggggtttcaccgtgttagccaggatggtctcgatctcctgaccttgtgatctccccacctcggcctcccagagtgccgggattacaggcacgagccaccgcacccagccaggcaaatccattattatagttgaagacttcaacatacctctagcactaattgacaaatccagtaggcagaaaaaagtagtgagaatatagatgtgcagtaccatgaatcaactggatctaattgacatttatagactagtttatccccaaacagcagaatacacattcttctcaagctcctatgaaacattaaccaagatagactacattttggaccataaaacatatcttaacaaatgtaaaagactagcaatcatacaaagtataacaccagagaattaaactagaaataagagaaagctggaaaatcctaaaattttggaaatgaaatgctagtaaataacacattggccacagaagtctcaagataagttaaaaaatattttgaattaaatgaaaatcaaaatttgggggatgtaaggaaagcagttcttagaggcaaatgtattgcaatgaatgtgtgcattaaaaaagaagaaagacctaatatcattaatctaaacttccaccttaggaacccaagaaaggagagcagtataaacctaaaacaagcagaagaaaagaaaaagaaataaaaattcaaacagaaatcagtgaaactaaaaactagaaaataataggaaaaattgagaagaccacaagctggttctttgaaagatcagtgaagttgataaatctttggccaggctaatgaagaaataaggaaagaagatataaattaattaatataaataaaagaaaggccaaggccgggtgcagtagctcatgcctgtaatcccaggactttgggaggccgaggcaggtggatcatgaggtcaggagatcaagaccatcctggccaacatggtgaaaccc[134 bp omitted]actccagcctggcgacagagcgagactccatctaaaaaaaaaaaagccatcactactgatctcatgaacattaaaaggataaaaaggaaatagaaataattctgtggccacaaatttaacaccatggataaaatggatcaattccttgaaagatacaaattaccaaaattcacaagaggagaaaaatataatctgaataggcctagacctattaaagaaagtgaatcaatatgcaataaactttcacaatagaaaacgccagacaaagatggtttcactgggcgaattatacaaaatttttaagaaataaatgataccaattatctgaagataaaagcagagtgaatgttttctatcccacttcaggaaaccagcattaccctgataccaaatctacgcaaagacattgcaagaaaggaaaattagagaccagtttctgtcatgaacgcagatacaaaaatcctcaacaaattattggcaaatcaaatccaagaatgtataaaataaactgtgcaccatgatgaagtgggatttgttccgggtataaaaaggctagtttaatatttcaaaatcaatgagtataatctattacaacaacagaccaaaggaaaaaaatcatgtgatcacatcgacaaatgcagaacaagcatctgacaaaatctaacacccattcattataaaaactctccgcaaactaggaatagaaagataactttttaaacttcataaaaaatatctacaaaaacactgcaatgaacagcattctcaatggtaagaaattagatgctttctcctaagatgtagaacaaggcaagcctgtcccttttcaccactccaattcaatattgtacaaaagtcctagctaatataataagataagaaaataaaataaaaggtatacagattcagaaggaagaaacaaaaccatctttgttcacagacatgattatctatatgaaaaatccccaaaacttggcaaaaactcctggaactagtaagaaataatagcaaggttgtaggataaaaggttattacacaaagtgaattgctttcctacataccagcaattaacttgcgggatttgaaatttaaaacacaatgccatttacattagcacaaaaataagtataaatctaacaaaatatgtacaagtctatgtgagcaaaactatcaaactctggtggaagaaactaaagaaaacctaaataaatggatagatattccatgttcatggataaaagactcaatactgttaatatatcagttcttccctatttaatctatagattcaacacgatcccaataaaaatcccaatgagtaattttgtggatgtcgacacatttattctaaaatgtatacagaaatgcaaaagaaccagaacaaccaacaaaatgctgaggaagaacaaagttggaggactgacactacctcacttcaagacttacaacaaaactatagtaatcaaggcagtgtggtcttggcaaaagaacagacaaataaatcaatggaacagaatagagaatttagaaatagacccacacaaatagtgaactgatctttaaaaagaagcaaaagcaatgcaatggagaaaggatagccttttcaacaaatggtggtggaacaacaggacgtccgcacacacaaaaatgaatgtagatactgataactttcacaaaatttaactcaaaaaggcaaaactacaaaacttctaaatgataacatagaagaaaatttaggggaccttgggtttggcaatgaatgtttagatatgagaaagaaaagactctttttatctgaagaatgtgagctcctttatcaggcccagagaggcattgaaatgtgacagcactcatgtctcctcccacctggaggtaagtaatcatttcaaagatgcctgttaaatgaattatagactgactattgccaccaagagctatgaattaacctaaaacaccccatgctgaacaccataatgcatgctctatagtacagctctatagttcaacaatgtatatagccaatcactaatcaatgttatctctgtaaaccaatgacaattcattaaaaacaacttttgtaatcaccctctctccctttttttttttttttttttggagacagaatcttactctgtcgcccgggctggagtgcaatggcgtgatctcggctcacggcaacctccacctcctgggttcaagtgattctcctgcctcagcctcccaaggagctgggattataggtgcataccaccacacccatctaatttttgtatttttagtagagatagggtttcaccatgttggccaggctggtctcgaactcctgacctcaggtgatctgccctccttggcctcccaaagtgctgggattacaggttgagccactgtgcctggctgcatcacgctctctcctaatttgttcttttttctttaaaaacttgagcctctcttttgttctgtggggcacttcctattgcttccctggctgcagtcctcaactttggtccaaataaactctatattaattttgcctgagtttctttctttagctcaacaggtataacataaaaaacatgatccatgaaagaaaaattggtaagttagacttcatcaaaattagtgcaaagtcactgtcgagaggataaaagacaagctacagacaagaagaaaaaatctttgcaaagcacatatcacctaaaggacgagtatgcaaaatatacaaagaattcttaaaattcagtgataaaaaagcaaataatccaattaaaatgagtgaaaaaatctgaacatacacctaaccaaggaaaatatacaggtggcaaataagcacatgaaaagatgctcaacattgtatgtcatgagggaattgcaaactagaacaatgagataccattacacacctattcaactggttaaattcagaaaaacaaaaacacaaacaacaagaaaaaactctcactatatcagatgctggcatgagtatggagcaaccggagctgttactgttggtggaaatacaaaatagtacagctcctttggaaaacaatttggtagtttctttatctttctttttttttattttatttatttatttatttatttatttatttatttatttatttatgagatagagtctcactctgtttgttgtccaggctggagtgcagtggcacgatcttggctcactgtaacctttgcctcccaggttcaagcaattctcctgcctcagactgccaaatagctgggattacaggcacccgccaccaagcgtggctaatttttgtattttttttgttttttgtttgtttgtttgtttttttagtagagacagggtttcatttactatgttggccaggcttgtcttgaactcctgatctcaggtgatccaccgatctcggcctcctgaagtgctgggattacaggcatgaaccactgtgcctggcctttttttttttttttctctgagatggagtctcactctgtcgccaggctggagtgcagtggcacattcttggctcacttcaacctctgcctcccgggttcgagtgattctcttgcctcagcctcccaagtagctgggactacaggcatgcgccaccacaccccgcaaatttttgtatttttagtagagatggggtttcaccatgttggccaggatgttctcgatcttttgacctcgtgatccacctgcctcggcctcccaaagtgctgggattacaggcgtgagccaccgtgcccggcagcctatttttatttttaatgtttttttagggatggggtcttgctgtgttgcccaggctggagtacagtggctattcacaggcaccatcccactactgatcagcacgggagttttgacctgctctgtttccaaccttggccagtttaccccttcttaggcaatctggtggttccctgctcccgggaggtcatcatattgatgctgaacttagcgcagacgcccaggcaacatagtgcactgcagcccagaactcctggcctcaagcgatcctcctgcctcagcctcctgagtagctgggactacaggcacgcgccaccacacctggccagtttactagtttctaacaaagctaaacattgtcttaacgtataatctaacagtcacactcttaggtatttactcaaacaagttgaaaacttatgcccaaacaaaaacctgcacacagatgtttatcatggttttcttcataattgtcaacagctggatcaagatagctctcagtaggtctattagttccctaagcctgccataacaaagggccacaaactgggtggcttaaaaccacaaaaacatattctctcaccattctggaggctagaagtctaaaatcagtgtgacagcagagtcttgctccctttgagactctgggtagaatccttccatgcctcttcctggcttctggtgctgcccagcaatccttagtgttccctggctcacagctcatcactccagtctcggcctccattgtcatgtgttgtttcccatgtgtgtcctgtcttcagatggcattttcctccttctttagggcaccagccacgttggattaggacccactcgaatgacctcattttaattgattatactgcaaaagcccttttccaaataaggtcacatacacagattccaagggtgaaagcttcagcatatctttctggaggatacaagtcaatccttaagaataggttaatgggccaggtgtggtggctcacacccgtaatcccagcactttgggaggccgagacaggcagatcacctaaggtcaggagtttgagaccagcctggccaacatggcaaaaccctgtctctattaaaaataaaaaattagctaggcatggtggcacacaccaataatctcagctacttgagaggctgaggcaagactcacttgaacctgggaggcggaggttgcagtgagctgagatcatgccactgcactccagcctgagcaacagagtgagactctctctggaaaaaaaaaaagaataagttcatgcataaacacaatatggtagattcatacaaggggattttttaagcaatcaaaagaaataagttatcaaatcataaaaagacatgaaggaaacttaaatcacattacttaataaaacaatccagtcagaaaaggcgacatatgtgctgggtacaatggctcacactttattacccagcactttaggaggccaaggcaagaggattgcttgagcctgggtgttcaagaccagcctgggcaacatggcaaaaccccatctctataaaaaatacaaaaattagctgggtgtggtggcacacgcctgtagtcccagctactagggaggctgaggtgggagaatcacttgaacccaggaggtcgaggctgcagtgagctgtgattgcactactgcactccagcctgggtgacagagtgacaccctgtcaaaaaaaaaaaaaaagaaggaaggaaagaaagaaagaaagaaagaaagaaagcgagcaacatattgtatgatgtaactatatgacattctagaaaaggtaaaactatagtgtaaaaggtctgcggttgccaaaggttggggtgaggggagggagtgagggatgaagagttgaagcaaagatttttaggacagtaaaacttttatttatatacatgacattatgcatgtgtcaaaacctatagaactatgtacaacataaagaatgaaccccaatgtaaactacggactttagttaataatgatgtattaatactggctcatcaattgcaacaaatgtaccactctaatacaagatgttaataataggggaaattgtgtggaggagggagagggaatgtgggaactctgtaatatctggtcaatttttctgtaaacctaaaactgttctaaaaaattaagtctattggccaggcacagtggctcacacctgtaatcccagcactttgggaggccatggcaggagaatcacttgaggccaggagtttgagcccagcctgggcaacataatgagactctgtctctacaaaaacatttttaaaaattaagtctataatttgaaaaaagattcactgcagtatataaggctctagtatcacttctttaaggaaatctttcctgctctcccatcatattcccaagatgggttaggtgctcttctcccaagctcccataataccctgcacatatatttatttctatggttgcacctaccacattgtattttaacatttatctgtatcgctgtcagttcatagctgtggtttgctgacgcttggcctagaatgcagagatggtgaaataagctaatccattgaaccctttaacaggcacctaggaatgcctgacaaagggcacttctgttccctcaatgcactgttgatgtcatttgtggtataatcattattagccctctggtccattaggctattttctggatgacggcataaggcacagtcttgtgacattaaaagttacttagcctgagtagtctctagattactggtctagggtctgccaaagacgatcctcatggggaagtttttgcactaacctctccaggattcaaatccaatggttttgacccaaaaccatgctgtttacgttacacaacacgttctcaatcttgttcaacttaaaaggtggcacagtacaggggtcactggcacacatgcctacatgacagataacataagtgacaaaagcagactcaggtcgagaagggtccctggcatttgggaaagtccatgcccagtctagaacaggcagccactccttggcttcagccaattgttgccacacagaaatgtggacacagtgttaccagacaaggcagagaggcagatttctgttcacacagaaacttttcagtttaaaaaagtgttggcaactaagtcaaactgcttagaaatactggagatggcatattgggagggtaaggaatcatccaattgaattggggtatttacgatgggggagaaatagcagctaaaggataagggcagcttttggagaaccctgattgtcacactcaaggaacttatatattgtcatctaggtctgagtgcacactaaataatttaagcaagaacaggacacgattagaatggtatttttaaaagatcacttggcagttgacgggcgaggctgagaccaaatggtgaattagaagtctgtcatttagctaagtaagggtaaaggcaagacggcaaaggcctatttacttggctttttctcctacccgactgcaaactccaagacagcagggccccacctgccttgttcattgctgtgtctccagcactaagcaaaaagcctgttcaacatttgttgaaagaataaatgaacaggagagagggaaggcgagaggcattttgaaggactgagtttaaaaatcaactaccttgaagccggtcgaggtggttcatgtctgtaatcccagcactttgggaggctgaggcgggtggatcacctgaggtcaggagtttgagaccagcccggccaatatggcgaagccccgtgtctactaaaaatacaaaaactagccgagagtggtggcatgcacctgttatcccagctactcaggaggctgaggcaggagaattgcttgaacctgggaggcagagattgcagtgagccaagattgtgacactgcctgggcgacagaaagagactctgtctcaaaaacagaaaacaaaacaaaacaaaacaaaacaaaatcaactaccttcagaggagtagaatgttggtaattgtgagagcagtcatggaggggaggggagccatggaggcctgtttccttccctgaacttcctcaacgagggggcatcttaaagaagaaatcatgtacacagatttttgtgggttttttttggagacagggtctcactctgtctcccaggttggagtgcagtggcatgaccatagctcactgcagcctacaactcccggcctcaagcaatcctctcacctcagcttcccaaagtgctgagattacaggcgcgaaccactgcgctcgaccctacacaggttttttaaaaagacgtttgtgcattggattcctggcacttcacgtggcctcttcagtctaccaaagaaggaaaaggtaagtaccctgaaggattgaaaggattaaatgaacattgagggatgagcaatttctgttcttccctggctccagcattaccaaagcacacagtaagaggactgacatcggcctccgacccagtgaggattactttcggggtggagggggaactgctaaacctcgaatctccgggactggccctggcgcgtttccagtcccagcagaaagggcaatccccatccagaccacactcctagtcctccttattcccacacagcccgtatcttgaccacccccagctccgccctctctcctcccacctccttttcccgctcccccgccccatttccttcttctccgcccacctcctcctgggtccctcccccggccatccgccctgccccggcccctgcaaccctgcctttcgctcttcttcctcctcccttccgtctgcgcccctcccgtggggccgtggcaaccccgtgcctcgcttgcccaatgagaacacggtttggggcggggcgcggccaggaccggagcggaagtggcgatcggagcggaagtggagctaccgccaccgccgccgccgattccggagccggggtagtcgccgccgccgccgccgctgcagccactgcaggcaccgctgccgccgcctgagtagtgggcttaggaaggaagaggtcatctcgctcggagcttcgctcggaagggtctttgttccctgcagccctcccacggtgagtgcggcgcggggtccgaccggggcccccgggggcccaaactcgaagcccctctctggctgctgcgacgacggcggcccagtgggtgggccccgtggggtagcggcgcgctgcctctttcgctccgcgcggccgccggcggcgaggccagacctcgcagcggcccctccctgtttccggggccgggccctttacctcttggagaggctcgggccgcctgaggtcctgccggccgggcggggtgcaactccgtactgtgccgtaagggacagcggagccggggatcccggaccctccctcactatctgcttcgggccccacgcgacccctccctgcgtcttggtcggcaagaacgtccccttcagccctgtcacctctgctccgtgctttctggtttccagaaattaaaatttaatcaaacgcggatgagttttctagccccagtccccgtgtttggctcctcctggatgagtaaggggtttaaccttgggagacagcagtgggggaaccccctcccattttgcagtaaaaccatttcatcatccttcactggttatggagcctggcaggacccaagattccctaggaagggaattgggtttgaatcaagaaaatctgtttgttggagccggttactgagtcaggccggatccccaggaaaaaatatcagggggtgagaatcggagtattttctcacagtatttaccgtcatttaatgccagattcttttgtgtctttaccccaaattcccccatattgtgtgttagcacgtttttcggtctgaaatttgcccggtggcttcctggtcggggggtggggagcggagggaagaagaggtgggaaggtgagtgcatctttgccgcaaatggagaactcccatataatggggttttcagaggtggcagccttggtaagcaatttgccaacctttctgtaaaatacatgtttcttgtcgttgccttcattgcatttctctttggtaaggctagatagcatcaggtcctgattttgcttgccctgtgtgggagatggaatttggcaagatgatgctatgaacataaaatcagcctcgggaaccaaaagagaaaggtgaagcacttataagaatatgaaaattgtctgcatttctcattctgtcagttcatgtgaagccagacacagatgcagtttgtagacctggacactgcagcttttgcattttcatttggaaatgtgtataagtatttgttcttggtgaatttcttcttgactgcttccagtgtaccctatttcttacttagggatatctcatttgtttgagccctcatttttcttggatccctgtccttggcaacacacggtgtgtgagtgtaaaacctgtcaatcttattggacctaagttagaaatttaagtgtggctttcaaaatggaaggctaataatcctgtagcaactgcagaattattttcctggcctgtccttccaatgagataagaaaccattcacctatcttgcagatgaagtctttatgagaaatgaggtgatttggcctagactatacacctagtttttttcaaactgaatatcctcattcatcagtagcaaatatttatggattgccagcccctggagtatgacgcctaccctgtaatcttttgtacatttcacatcttgcagtgcttgttatattgaagccattttagaattggagcgctatagatcagggaggcagcctctataaaaccaggctgagcaaattcccatgatgctggttctctaggcagagtctccagagatttgggccgctacaaaaagtgcattttgcccattcggctgtggatagagaagcaggaagagcactggacttggagtcaggtaaatttggttgaaatcttgcctgcaatattttctagctttctgaatcttcagcatgttaatctctggttcttggttttcttatttccagggttatcattaagccttttttataaactgtaaattgttaaatataagcttttggtttgttttttaatcagagttcactattaatggctttttctctccagttaacatctgatgacactaaaccctgctttgtacacatgttgctttcaaaaaatggtatattattataggactttattttgcatataggcaaatccagtctttctgaatcattttctcgtctatatagcacaaatggtaatgcagcttttgatatatttttgttgcgacaagctcaataatgaaaataagcatctgggatatagttggggttcaatagatgttattgaccatctgcatgaatatacacgtgtatagattagacatagcatatatgctattcatggacatttatatagaatccatccatttgtgatttattcaccaactgatgaggtggtatcagacaattagtctataataatagttaccacttacagtacttactgtgtgctaagctttcttttaagcactttaagcatattagctcagtcttcataacaaccaatgaaaggtaagactgttagccccattttacagatggggaaactaaggcactgagaaggataattttcccgaggtctcacacacagcgcaaggtaagtgccagaaccaggaatgaaaccaggtgatctggttctgaggaatgatattatagatttctgcatgtggtagagacagcacatgtatatgttttatgtgaacaccatttagtccttaatttttctttacaccaatcctaataaagtaaacgtttgaatgggaatattagctatttttgaagatagatacaggacaatttattgtggagcatatacccattctggcctgtagggatgataattgctagcatgcatcaggaagcaagcttgtgaacaatccagtttttctagtacttgcttcatactagggagaaagtcatcagttactttggcatagaattttaggttcttcatctaatagaatttgattgtgaccattaatttttgtttatcttacgacttcatcagtagatgttcagatttttctcattttgttggcagggaggaaatgaggaaatatatctacgtaaatagagagaaacttctaaattaaaacatcctgttgtgctacctgctctttcggtgtcaacaaactgagttttcctttaaatgctggtaccttagagaatgaactaaaatttccttgtagagatacttttaagttccttgtttctacatttttctagggaaagatgacaattcactagttaaggggcaagaaattatggttacataatagcaacctttaagctttagaatccttttgatctctatgtgaatatgatcttagcagtcatctgtattgcatgatggagaaactaacggttggagctggattctgagggaatttttctaaggggaatacttgaggaaacagactaaaagtgctttctgtctcatgatatgtgtgctgaaggccaatcatcttactgctttctcaactaaaagattttctaatagaggtgtggttatatgtatctgatacttgtaatgagatgtaaatgatcagtggcctcaagtcattcctagcagattgtaggttagttaactttttttttttttttaaattctggccagttctttattatgtaagtttttcccgtactggttagtttattttattgttttccctaaaagaaccaacaggaggttatttctgaatggccttgaccaggacaagaagattgaaggctacaataaagtagatatgagtcctgtctattattattatttgccctcagctaagagctttcctttaaaatttgtttgacattttggtaagtctttggcatgtttttatgctgtttttaactccttgattttgtttttatttttaaagctagataacattagcttaataggccagttttaaaatttcactgtaacaaccttgtatagttcttttaaaagttgacaattctctcttttccttaagtgagcattggagttcataattgatctttaggagatagggttacataaaggaaagagcattaattttaaaattaatgttggtttagatcccagatctgccatatatagctgtgtgaccctgaatgagttaactctttgcatttataaaacgggacaatgtcacctgcctcataggatacttaggatcaaatgcgtttctaggaatccctgagtgctttgcaggccataaatgatggatggatatttttgttatttactaaacgagttagctggtttgggtttctgtatagtgaactttttgtatagcgaactgattggacttctgaatggaggagatggacagaaagtaatccaaaggcttgttgaaagtcagtttgaatctataaatacaatgattggtagctgaaaaatattagtcaaaatgtatagtgttgctcctgatgagagctggctggcttttttcaaaaagtagtctaagacaataaaaacagtctgtattttataggtcagatgtgtgctaccttcctctgtccacgtaggaaataattgctttttcactttttaagaatgcatcagttgatcaagcagtcactcagtgtgctaggccttgtactccacattgggtgtccaaagatacaagtctggattcctacttttttttttttttttttttttttttgtgagatggagtctcactctgtcacccaggctggagtgcagtggcacgatcttggctcactgcaacctctgaagcccgggttcaagcaattctcctgcctcagcctcctgagtagctgggattacaggcgcctgccactgcgcccagctaatttttgtatttttagtagagacagggtttcgccatcttggccaggctggtcttgaactcctgaccttgcgatccacctgcctcggcctcccaaagtgctgggattacaggcgtgagccaccacgcctggctggattcctactttaagctcacaatccggtgtgggagccagcagagacacttgcattgcagtaaactgtgataagggccattttagaaataagcatagggaaattgttatgtgcctttcttttaaaagtctttaaagaaagcagagtacgtgtaaaataaatgaggtacatagtaagtttcccttcactggctgaccattggttttttaagttttgtgtggaatgtactgtggttgccatttatttgagtgcttactgttttatatcataaacaggtttactccttacaggaaccctagtaagtagatttgcctatgtttttttttttcttcacagagtcttgctctgtcgcctaggctggagtgcagtggcgtgatctcagctcactgcagcctctgccttcaggctgcctcagcctcccaattagctgggattacaggcgcctgccactatacccggctaatttttttatatatttagtagagacggggtttcaccatgttggccaggctggtcttgaactcctgacctcaagtgatcaccctcctcggcctcccagagtgctgggattacaggcgtgagccaccacgcccagcccagatttgcctgtattatggatgagaaaacaaattcacagaggtcacatagcctgtggacttggtgtgcggtactggtaaatcagactgataggcttcattatgtcagtgggccccaaactgtagaaattattcataaggtcaaccaattgggctgtctttatggatcagaattaacatagtgtcttttggattgattacttaagccaagaagtcaatttattgtcatatctaccattaagtcacatgtgtaaccttgcgcctgtcacttaacaccctcagtaagtttaatcatggctaattggacataattagcaatgatatgcaacagctgatgtgaaagagggaagggattttgaaataatagaaatgcagtttctctccaaattcagtgttcactggacttagtgctaatgactttgtattacagatatgctgtgttttgtttcctaacaaagaacctgcaaatgtttgaatggaattaaatttattacaggactctaaattttatatgtagaatggcacacagacagttttatagtgggtgttttttagtgagtagttttctctgagagccaggagtgtttaactttttctgggtaacacccactaaccacctggtcccactgactttctcagtcccttctgcagtagcttggcatctgatttttcttcagcagagagactccagaactaaaacttctgctgtacagtgctgtggatgctctatctggaatggtacatctgtgaatgctgttcagaatatgtgatcagttccttaccccattgaaacattcgagcctagatttttcagattttcttgtcagttttcttccttattctcatttctttatctgctttggcctttgatttttatctcatctagaaaaacatacatgcactttattaataacatctctttttaagtcacgacctagctacctttaaacctatttcctctagttctgtctggttggctttctaaggagaggcattgtaacccttaaacgtgtgctgtttttttttttaattgatgtgtaatagatatacatgtgctcttttcttgtgtttctaccactagagtttaagctctctgaggggaggactacactgctttcttttaaattcctctcaatgaataatccaaagagttcttagaaatttggtagtttttcattttgttagttatttcaacacacattggattatatgtgttacatttttgtgaggtagcttaagaataaaaaataagaatggcttatgagcctttactctaaccagcactatatgggcattttatgttcattatcttatttgatagctattaatgtctctttttaacactgagaaaacagattcaggtaagttataatgtggaaatgtagaaaaatcacctactttctctttagaagctcagatgtgtatgtaaggcttgctaaaagcagaccccaccgtatattttatatgtatagagcttgggtaattcctgacatataataatggagtcttcatctgaaatttctaacaaattattaaattcaaagcttattattttcgaatcgagcatgttctttgccttgaaaacaaaacatagctgaaagccagtgcttctaaaggccacagctgtcattttcaaccctttctgtctttgcactgcctttatttaaaaaaaaatggattagcagtaggtagtcttctttttcttttctttctttcttttttgattcttctcctaggatatctgctctagccactgggaaataacttctcagtattttgaccctgactagaaagatgtcccttggggaaggaattgggatagaggggctaggctgtttcctagatcctctattttcagcatttattatctgatttaggattttgtttctttgaagaaaatcctattttgtgagtacctttagaattatttttcatagctgtttatctgcactagtggtttctctttaaacagaaaaacactttttttcttaaaaaaagaaatagtacccaatttttaaaaaagtaatacatacttgaagaaaatttaaaaagataggaaaatgaggatataataatgttattacccagagacagaaccagtgttaaccatttggtgtaacctttctgttcgggtttgtttgttctttaggggatattttacagaaataaaatattgtgcagcctcgtccctccagcccccattgctcttaaataaatcttttcatgacattaaatctcttcttttgatggccacgtaatcttgtaccatctatctccttccctcccctgcctttttttttttttttttttttgagacggagtttcgctcttgtcgcccaggctggagtgtagtggcgcagtttcggctcactgcaacctccacctcctgggttcaagtgattatcctgcctcagcctcccgagtagctgggattacagtcatacaccaccccggctaatttttttgtatttttagtagaaacggggtttcaccacattggccacgctggtctcgaactcctgacttcaggtgatctgcctgccttggcctcccaaagtgctgggattacacacgtaagccagtgcacctggccagtctccttattttttaaaccattcccatattgttggatatttagatttgcttccattttttcactaagcaatctctgcgtttatcaacaaatgcttcccagtcctgacttgctgcatccagtggcttagaacagattgacagccatcatcatcatataggtgtgctggagagctcctgttctcaagcacgtcagtctcttcctgaaatatgcccagcacaaggaaaatctcttggcttactgcagggttgggccttttgtggcctctaatgagtttgcctgcgccagtatcttgatgcttctgcagtggtgccaggcctgacgatgagactatagtctttcaaaaactttttaggagacaaataaagagtatcttgctgactttttttttagtgggaacctcattcaaagtcttggaacaacagtaggtcttgattaaaaaccatcatggcatatcactagaaaattcaattagaaactaatggataaacttcagttacatttaacatatatgtccattttaacataacatactaactatctgtacaagattaatctagacttttgcttttccttctcacaaaattgtatatttaaaaagaaaattcaagcttatggttttatgggctgctacagtgtaatagtcgtggagaagaataatagtacttcagtttgattttgcactatgcatttttcaaggaagatttccacatttagtattctttaattccctgcgcctcatcttcacagcaactctactgaggtagatgccatcttcattttatggattggaaggctgagatttaacatgctcacatggctgtatagtggcacattgcgctgtgacacacagtcctgctgccttccgactatactacatataggtactctgtgttccttgtgctctcccaataatgatttgtagaaaaacttgatattcatttgcatatgagttttgtgcttagcacagttataagcattaaatgtgaaacaaacatgaagctttcctttgagggcacacacgtgaagctgtaagtggtacagtactcatctgtatcacagaatggcataaagaagtcctagaccatgtaataggctataagtatattcagagtcataggcaaggtaaatcagtgagggctagggcagtcagggaagggtttgtagccctagaagaatgggtggagttcagataggcaggcagtaaataggagagcactctagatgaagggaactacaaaagcagtttcagacacgtttgagcattgtgtttatagggcatgtggtgctggccagcctgagagaaaggtacatgttggagaacagtggatgagaaagccaaacaagtaaagaggagacaatttatcaggaatttgaaagccaggtagagcttaaatttgatggagtagccaaaagggagtcattggaagttactgagtaaggacaaaggcaagactagaggtaatttaggaagagtaattttttgtttgttttgagacagggtgtctgtcacccaggctggagtgcagtgatgcagtcatggctcagtgcatccctggcctcctagcctcaagcgattctcccatctcagcctcccaagtagctgggaccacaggcatgagccaccacacctggctaatattttattttttgtagagacaaggtcttactatgttgcccaggctggtcttgaactcctggtctcaagcgatgctccagctttggcctccaaaagcactgggattatagattgatctgccatgcctgactggaagagtgaattactctttgaatttcagagggcacagaaattcaagaaactaggtacaaatgtaatgaagatttaatatgcttgtgaggctaataggtgctttgaattatttgagaaaagggagaactctaccaactctgcagttttatgcttacatttcaggatcagtttgttcattcagcagatatttgttcctaccaattatgtacaggatgctgtgggagatatgtccaaaggagcttatggtgtaggaagggaaataggagacactatgtaagtaattttagtactgaagaaacgtggtaagacattgacaggtatcagcgaaatgctttgtgagaatatattcattagagcaatgccgtcccataggaatagaatataagccacatgtaatttaaatttttctggtagctgcatttaaaaatttttttaaagtgaaattgattctatctgtttttacttaacccattatgaacaaaatatgatttcaatatgtggcactagccacattttaagtgaatagccacatgtagctatggctatggcttaaacagcttaagaaaggcttcatggaagggatggtatctgagccacactgtgaagaatcttgtatgcagagtaaatttgggaaaagccattccaggtagagggagtggcttggtgagcaaagatagaaaagcatactttgtatgtaagaaaaccattttggcagaagcacatatgatgtggaaggcatgatgtgggggtctggaagataggttggcaagctttcactgataggggaggaaatctgactctgcttttggcatcagggaactttaaagaattttgagcgggaagtgacttgagcagagttataggaaaatgggtcttacagcaaaggcatggagggggctgtagataatgagtgactgaaagcattgccactagggcaagattttggatgggagatttattgtagatgtagaaataggaacaatttcatttctcctttgctgccttcctccaaactgctgggtgttgtgtaacccatttcctgttgaaattggtctagttgcttcaaaatccatgttatataagtcaaaagttatgtaagcagtagccatcaggacctttagctatggattttgtttgttgtaagttgtttctgtatgtgtataattaaaaatatttgaaacagataaatggatacagattttaaaaaggtgtgcattcagtccttatcttgccatgatggttctcaatctctaagaaatcttgcagtaatctcggagaagcttaaaatagctgaccccaaacagaaagggtgcattttattttgggaaatagggaaggcatatttgggaggtcccactgaatagtccagattctttggagtagtatgatttaacttttaatccttgagaaggagagaagtaaaagggggatagcttaattttggggcctagtagagctgaagaggttgatggcattatttagcaacggcaatcctttattactccattatgataccacatgggatggcttagctctgaattggcttttggccagtactttatgatttggagtaatccacaggtagagttgcataggtactgttctatgaactttgaagtgggcctctaagtgacttctaactttgagttagtctacagactggaaattttctgaaggttgttgggtcattgaaagttggcttctttctggtgtacctggcacttttagaaaccatgaagtagggttatttaatgatgaagatatttattgtcctgatctcaaagaccttatggtcaagaaagttagatatatgaagacagtggtcatcctttggtatccagggggtgtaggttccaggacacctggggataccaaaatctgaagatacttgtttattttgtgtttttttccttctttattttccaccacggttggttgaatctgtgtatctggaacctgcagatatggagggccaactatatatacttttaagatggtagagtatttttgatgtacttgtattagagtagaacaggttgtcttgtggtaaccaacagctccagcatctcaatgttttaacccagcaaaagtttcttttgttttcaccctgcgtgtccaatgcaggtctgcaggagtcttgcactatacagtcacccggggactcaggctgacaaaaactctacagttgcatgactgtaccacctagaatacatggccttctcagtggctgctgtgagggaaaagagcctggggaggcacacgtaggatattcacagtgttagcctggaagtagcgtcatttctacttatctttcattggacagaactaccatgtggcctcttctgactgctgtgggggttctgggaaatagaagggaacaaatggaatgtttcttgaggattactctctctgccttagttttattctagtgttgtgagtgaagatgtcagatggatcaaagtgagacttgcctcactgagtgtaagcttacaattagtgagccttatataagacacagctctgcatgtgatttagataataagcagtaggaagaaaaattatagttatgaactggagaatcaattctttctgaatcacctagattttgagtgtatcttattgtgctccctaaaacatttttaggtgataaggccctgtgtgtagaatttctctcttgaaaatacagaaatgacttttgaggcaaaatcattttgtgagtggaggtcatactttcttgttttttttttccttttttttttgagatggaatcttgctctgttgcccaggccagagtgcagtggcgcgatctctgctcactgcaacctccgtcttccgggttcaagcgattctcttgctcagcctccccagtagctgggactataggcacgtgcactgtgcccagctaattttttgtttttttagtagagacggggtttcaccgtgttagccaggatggtctcgatctcctgacctcgtgattcacctgcctcggcctcccaaagtgctgggattacaggcatgagccactgcgcccagcagaaaatggttaatttaaaaatagcaaagaggccaagtgcggtggctcacacctgtaattccagcactttgggaggccgaggcaggcagatcacctgaggtcaggcgttcaagaccagcctgagcaatgtagtgaaaccccacctctactaaaaatacaaaatcagccgagtgtggtggtgcatgccagcagtcccagctactcgggtggctgaggagaatcgcttgaacccaggaggcagaggttgcagtgagccgaggttgcgtcactgaactccagcctgggtgacagaatgagactccgtctccaaacaaataatcattttcagagccttaaattgtgataccatgtatgtagtaatgaaagaatttgttttgaaaatactggcattggctaggtgcagtgggtcacgcctgtaagtcccagcactttgggaggccaaggcgggcagatcacctgagtttaggagttcaagaccagcctggccaaaaatggcaaaatcccatctctactaaaaatacaaaagttagctgtgcatggtggcacgtgcctgtaatcccagctacctgggaggctaaggcaggagaatcacttgaaccctggaggtggaggttgcagtgaaccgagatcccaccactgtacttcagcctgggtgacagagtgagactctgtctcaaacaaacagacaaagcacacaaaaaaacctgacattactactactgtttaaagtagcatttcatgtttttatagctcaggatattagtgtatttttatactgtgtggcacagattgatatatcaatatttaaaccaacagtacataaaattaactcttcttgtttagtaaataacttttcaattattttatccaaaaattacttattaaaattaccgcactctgtaaatggtgattattgcagtggggaactgactgtggtgagttgataagagatattcactgattggcatatggatttgataaattgataaactgaagtcactaggatttttgtctatttcagaaaaactttaaatgaactcagttatggttcagatgaattcagttatggtttcaagttatgttgctgtacatcttgttatacacccctttctcttgcaacctataccatatacaaaattagtgcctgatatttttatataatgctttatactttttaaggtgccttcacatgtatcaggtcttttgttcctcataacaggcccactaaaagagttggtagtgttctttctttttttttttagagacaggggtctcagttggttgcccaggctggaatgtaatggcacagtcacggctcactgcatcctggaactctgggctcaagtgatcctcccacctcagcctcctgagtagctgggactacaggtgcacaccaccacacccagccaattttttcttcttttgtagagatgaagtcttactatgttagagactgatttgccaggataatcttgaactcttgggatcctaggcgtgagtcaccacatccagccctgggtagtgttcttattgcccagtagagaccgaagctctcaggttaagtgatttaaccaaggtcatgccacttgtaagtaagtagcagagctagtgctagatagagcccaagtctgactgcccttagtttatgttcttcctgtgcagtgtgtcctagtaacaaagttagcagattacagaagatgtgatataatctttcccatccttcagttatctactgcttgatgggtgcagccaaatagatcatttaaaatcatatcttttgcttcaggattggttgaaacaaacatcatacttactctttcctgtactatggaaaaaacaggtttagtcaaaaccagagttgcttacaggacagtgaagagaggacttcctgtattacaggatacagttggattaaggtcattaaaacaaaccagacaattactgagagaagtcaaggacatatatatagtaagcataaactttttttttgagatggagtctcactctgttgcccacgctggagtccagtggcgtgatctcggcccactgcaacctctgccttttggtttcaagcgatcctcctgcctcagcctccccagtagctgggattacaaatgcctgccaccacgcctggctaatttttgtatttttagtagagatggggtttcactgtgttggtcaggctggtctcgaactcctgacctcgtgaattgccctcctcggcctcccagagtgctgggattacaggtgtgagccactgcacccggctagtaagcataaacttctaaagaaatagttattaagcagtctgtatgtgccaggcaggtgaattaggctaatggaagaaaacaaaagctctagagccagatagatgtgagctggagttctggctctccaccatctatttgcatgttgctctgggcatatcacttgccttccctgaccctccatttcttcacccataagaaggggaaagttgttgttatgaacatacctactctgggactgttgggaagattactggaccaaaataatataaaggccttagcaaagtacttaaccctagaggtgtttgatatatcatcaatattgttgatggcatttggaatgagatgtttcacatttagtatgctgctttccagatgggttggaagaagattcacacacgtttcctaggccccgaaacctgacatttgctctttctttttctcttgctcttgttctagggaatgacaatggataaaagtgagctggtacagaaagccaaactcgctgagcaggctgagcgatatgatgatatggctgcagccatgaaggcagtcacagaacaggggcatgaactctccaacgaagagagaaatctgctctctgttgcctacaagaatgtggtaggcgcccgccgctcttcctggcgtgtcatctccagcattgagcagaaaacagagaggaatgagaagaagcagcagatgggcaaagagtaccgtgagaagatagaggcagaactgcaggacatctgcaatgatgttctggtaagaggccagtgcttctgttttgaacagtggtttctaaatagtattaatttaatgtataaatgcagactctcaaaacagcttatgagagagaggtgtctgaatatactggaaagctgccaggtatttacaactaatttttaagcatatgatataatttgtgtcacctattgcctgatcagaggttgtacatcacttctgagatactttcctctcctatcaaaaagacctgtgaaaaacagtgacattttttcagcctccctccatcttttaaaattgaggccagatagacaggattttaatagatacagctacagataggctattgtgtatattagtcagagtagtgatgtcatcgccagtaggggagggagatgaaaaagctgagctgcctttcagcctctccccagtcatgccttcacactgtaaagtcctgctttggtctgaaagttaggcacatccatcaagttcggcatgcattccagagccaaattcaaagtgttttgggcattctcctctcctgtattttacataaacccttagtcagatgattgattccctctggccgccacttgggattgaatgggaggggtacgtactccaaaacaaatcataatcatattgtctttcccgcacatcctgagccattgggaactttctttttcttccaggtgaaatcaggtaaaaatgaactcagcgagggctgctttgaagggaaaaggaattcacacttggggacctaccaccttccctgctggctgcctttctaaattactgcccatgactcctttcttttgaaaaccagtataaagcttgtcagccatcaggcagcaccccttatccctaacctattaggagttacacactgtctgtctacaaagaatattaaaacgactgccgccccctgcatcttctcactttggttgattaaatccccttataactaagctttgcattgagcttctctttttattagactcatggcgtaagagtgtcatgactaaatttgttgcctgttggtaatttgggggtttgttaatggtgcactaattcctgaatgttaggtacatctggtattcagatgaagtatgtcatgcattccaagggcaagaaagttccataattcatgaaatgtagaccaacttttaagagcatctgaaagaatgtgaagaagagcttggtacttactgcctcttaaccagtttttcaggatgccacattctaaaacaactcttcgaaaatattgctctgtatacgaagcttggactccttcagaactacttttgttgtaagcataaatgtttaaaggaatttattattaatagtattagctactctttgagtgcttactacgtgccaggcaacgtgttaagcgctttatgtatgtcaacttatttatcattataactaccctagaagatggctataccctagaagatgacccttcgtatagctgaggaaagtgaggctcaaagtgattaggtaatttgtccagagtcatacagataataagtggcagaagagggatttctacccaggtcagattgactttaaacttagttcttggcagttttgctctattatcacctttttcctcctaaggaaagatattttttcccctttaattatagaagtaataccagtttgtgggtttaaaaatggtggggggaacaagtcagaagaatataaataagaaagtaaaaatcacttctaatcttaccacccagagaaccattattaacatactccttccaggcttttcccttatatatttgtgagcatgtacacaaatgtatcttaatgttaaaataggattcttgtggtatttataatctgctttttttccactcagatttcttttgagagcctttccattatctgtttagctctgcatcattttaaaggcctacaaaacatttcattatatggctatactttaattatcccctatggatggtcaaagtgatttttaacagaagaatacaggcatctgctgttatgacctgggctaaacaacatttagtagcttggatgaaaaattggtgtttttttaatcttccaaaaaattatttagaagcagtagtgtatatcttgaatctcaaacatagttttaacatctcgtgaataattctaaattcttaacaatgttcattttttaggagctgttggacaaatatcttattcccaatgctacacaaccagaaagtaaggtgttctacttgaaaatgaaaggagattattttaggtatctttctgaagtggcatctggagacaacaaacaaagtaagtaatatctttaaaaagaaattcgaccagtaatggagccagtcttctttcacagggactttttaacgatttttgctttgttcgccatagacaccaatgtcacagtactaagaatttaaaagaccacagcattgtgacgaacggggtcatgggcgggcaaataaaaatttatctgacagggaagtatggagggcattacaaacctggtgcgcagtgtatttaaaaagatcttatcttgagtattatttgttagctctctttttagcagtgaactttttatacttggtggtacgaaactaccctagtgatgcattgcatttatcacatgtattaccgtgatggtggtaatcttaaccacactttattaagtgcttctgtgccaagtacttccgagtctcacttactcttcacacagccttacgagttaggtggcaggctgcccatttttcatataaactgaggtttatggaggtttctacttgccccaagccacagacctagggagtaagagttgggaattaaagtttggatctatcgactctaaagcctgtgatgtttgcactagaatgtatggtttttcacattctatattgttaaaggttatagctgtatttaactgctttagtagactttgtcataattgttttcccccaaagcatttaatatacaacttggtttagaataaatatctaacaaatgtataattgaatggcagagacactgacacttcatttgataggtcattgctcctgcccagtttgggactgagaaaataatttgatagttggtccaatgtgtgatacctatgaaagaaccgagcctttaatattttcatctttatgttacagccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggtgagaaagaccctttgtgatatctaaccatagcaaaacagtgcttgtgttattaacttcattttattcctgaacatactcattgtcttggactttttttgaaagattttctgggggtgggagtgtatcttttatgagataaatacagatctgttacttttttaattcattctcaataccttctgctgactttgtttgattactgttttttgcgggtggttgtagaaagttccaggtgaatgtagttagttgtttcttaccaagctttgggccttggttatacattgtcattctcatgccaagatttgaggttatagttgtataaaagaaatacacagcacattcttgttgtgtgttggattaccttccatattcttcctttggccttctctacatattttttatagtccctcaacatgcacacaactttttaaaaacatttttattcgggaaaggtgccttaaagttccgtcacttaaatcagatttagtgatgtgagtttccagacattttgagttttagtttaaataaataaataattttaaatagaagattgctagaaaagtctttggtaattaaaaaatcacacgcgtttgcccagaatgactgtgctagggttagcagtaatactgcttagttattaggtacagcaaagttcttaccttggagtttctgtcattgttggttggtgctttgtaaatatgccttatacttctgctggaaacagctaacagacagggtaataatagcctaggttcccccaaagtactgtacaagaagataagttatattcacctagcgggaaaaaaagtgggctaaactagctccagagaacttgtgaattctttgctaaaggctctttgttttaggcatttgatgaagcaattgctgaattggatacgctgaatgaagagtcttataaagacagcactctgatcatgcagttacttagggacaatctcactgtaagtactacttccacagggtttatagtctctttcctattcacctacttaataattcactgttatcttcaagaggggatttgtaccattaaatgtagttacagttttaagttgttaaatttgttataaatgactgctgaagttttgacctttgcaatcatccctgtctgcagtgacacaggaataattttaaactgtcgagtgagataagattatacatactgggccacttacctagggaacttttagtagccctgctttgattatacttcctttctcttgcagctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaagagaatcgtacgtcgactttcgatttttcacagcctcagcctaggaaaaatggttcatgggataaacagctggtatttgtatctaaaactcagattggtcacataaatgccacggcattccgaagttttgattttgattaacattgacaggattactgtgtgtttaattttttaaaaactgaacactgtgattatggggttttgtaatttagcagaactcttactggtagaaaaaatagacctgaattatgtgtaactttttggaaggtttaatctgatatcaaaataatcattgaaatacaattccattgtaaagttgtacagaaagttatagagattatattgtgatgctggaacttggagtgagacacacatcatttggcatttgagttgaatggtaattcacagtaatgctgccgttgttcgggacttaaagacacttgacctgtttgggctgttgccacttaaaagttcatgaccacaaatgtccacagtgtcttcctctgaggaaactcgaatcctgaaatggaaattctttgtggcagataactggcttatgacaccttgaaaagttcaagtgctcatataacacaccacactgaaccccctttcctacagcaatatgttcactatgttaccaatttgcaacttgtgcttcaatagtggaatctactttcattgttaacactgagctaaagaaaaaaagccgtgtgttttatgaatgaccttatctgtttcctggataatacctttaagaataatgtcctgagtcaggcgtggtggtgcgtgcatctagtcccaactatttgggaggctgaggcaggaggatcgcttgagcccaggagtttaaagctgcagtgccctgtggttgcacctgtgaataactgcactccagcctgggcaacatagcgagacctcatctccaaaaaagaaaacaaaaaacaaaaaaaggaatgatgttctgtagagatggcctttcacttgaggagtactcagttttcaggttcttcctagctcggggcttttaaattttgaaatctaaacattctttcccaccatcctttttgactgttgaccttggttttctcttctaagtttctgtccctctgcttccttactttttttcctttttgaattctatctttatctgtcttttgttcactttttaatgctatatatgggcaggggtgagagacattactgagcaccttggtgagcaagcctggctttaaagattggagaagagcttctggcaccagaaccctgtcttcctccagttctcaacacggtgttgctcttcagtcataccggaatctgaatcaaaaaagtatttttaaatatccatgatttctccctgtattgaggctagccctgatcatgctttttgtgcctgtcaccaggtctcccaagtgcactcatccaggtcagtgctcagatgtgtttaaggagaccctatattcagggaagttgcgtgaacactgcagtggggagaattgagaatagtcaggcctatcagtctcacagaatcacccctctacctttgatattccacttagctgtagagtccatctgtttgtccatctgctgaaatgagaaaagaaaaatttatgcactgatttaaaacaaaccaaaaaaaaagaaaaaaacaaaaaaaaaaatccctcctttctagctgaacaaaaatgtgcagttaatacttggcgcttgaaaatgcagtagtgaatgtggaaccaagcctgtctgtatatctggtagctcttttcttgctttgttttttcttaccagtattctgcctaacgtttgcttctgtgatggttatattgcctagcaagcacacccgtggttgtgaaaatagtatagcaaaaaagaaaaatccccggttattgatgtactagatttgtgtatgtcttttaaacagttctagtttcaccttacacagaataatcaggaaaagtgtaaaaattcaaaagtgaaataaaaattttatcagttagttgcctgtgaattgatgtgtcaccaccatctctgttgttaccagacctagctaactattctgatcacacttatttttaactctgttttctttaaaaataggcaaacagttttatttcattatttaggaccagaagtcaaggtgttatccaggggaagaaattaccattaattaaacagcctctttacacccgttacttgatacctctctaccttccacaacaaaccatgcaggtattaggtcctctttagtgacttctaagatttggtatggacagttattttgcattgtattcgagcccaccatcccttccccattttttaactctgagatacaaccaagccagtgaaataggtaacctatggttgcataagtcttggtcatcaccaagctggcgtctcacctgtcctcacactgtatggtggcctgcagagctggttcctcacaggatttgccccttctgaaaacatccacattaccacaaggagagaaaaatatcaggatagaggggtcttttttagcccaagattagaattagtgcttccttgctactctgaggctggacagccagatgggcaccttctgtccctagtttaggagctgttccacctgttgaagccacactcaaccaaaagtcagtgggggcctacctgctctgttggatcagtgagaccaggaaagtcctatcagaggaaaagtgaagtattggtgctcagtggagtagttgttttgtttttgtgttgtttttaatgtccctataccacagattgacgctgcaagctcagattcacagtcttgctctgtttaggtcttgctctgctattagttcccaattgtccgcatttaggctgagccacaagtaactcagtgaacctccctggtgtaatggatgtgtaatggcttagcagagggacagggaatatcccaggaaaaggggtcttggtaatatgagccagtaccaagaaaggccttagtggtctccagttctcatgtctcaaagccatttccatccttggtgcgaaacggtgggactggatcaggctctctggaggaagacatcttcaatggagcagggtaaaattctctacacaagctttgaaacagtggcctgttcggaattccgtttgtgtgtgaaacgcaaaaagcgcggtttgggtctcctttcattcttgtcaggagggaatcattcccattttacagagaagggaaacgggttcagaaagatgatcatctgttccggggttagaactcagtcccctgcgtcctttccgtcccagtcctcggctctttcaaaagagctgggggttttgagagctccactcaagtcccagcagccctgctcaaggccaggttgaaggctttttccgcctcccagggcggggtcagaggtgtccccacctgtagcttttagatccccaagtgctcgcaggtggggggtgggcccaggagggatcccgggggaggggcgtccgagcgcgcccacgattggtgcgcagggacgcgggggcggtaaagggaaggggcgggcccgcgcccaggaaggagggcttccgcccgggtgagcgcggggctgctgggtgacccggctcctgcttgccccgcagccccggccccctgcccaccatgaacgccagcggttctggctacccgcttgcctcgctttacgtgggcgatctgcaccccgacgtgaccgaggccatgctctatgagaagttctctcccgccggccccatcctgtccatccgcgtgtgccgcgatgtagccacccggcgctcgctgggctacgcctacatcaacttccagcagcccgcggacggtgagccccggggatggggcgggaggggaaggaccgacggacaagcaggcggacagacagaagccggaactgggccgcttgcgctttcatcttacactttgcagccggggaaactgaggctcaaagataacagggcgttggcagaggcctggcccctgagacgggaattggtaattagtgtggtttactgctattcctctacagaggagagagattagggtcgagtgaaaacagatacaggctttgtgggggtgggggtgggggtcaggcggaccagggatagaagcccagcagccgtgtgactctgggcaagttactcgaccattctgagcttcagatgcgtgtctggaaaatgggggtcctagctgccttatagagtgcttgtgaggatgagagattcaaagcacctggtgaggaagatgcccaaggcaacacagctggtgagcaggggaggcaggagaacccagccttgggctcaggcctttcccagcgcgacgtgagatccacactgggcgcctctacctgcacgggctctgaaaaaccgctgcctccaggccgcaaggccgctttctcagagctgatagcattgattagagcttgtccgatgagtttgcctgcacttctgttgagagtggagaggatgagtgagcttgggcaagccttcacgctctgcaccttttcatctgcaaaatggggctaaggcgtattctccaataacataaagaatggagaactgctgtctatgcataaagaatggtaactgcttgttacctcgtaaacgctcttaagtggtaacctaaaataaataaataaataaataaataaataaataaataaataaataaggccaggcgcagtggctcacgcctgtaatcccagcatcttaggaggccgaggtgggcagatcacttgaggtcaggagttcgagaccagcctggccaacatagcgaaaccctttctctactaaaaatacaaaaaatagctgggcatgatggcggacgcctgtaatcccaactgctggggaggctgaggcacgagaatcgcttgaatccgggaggcagaggttgcagtgagccgagactgcgccattgcactccagcccgggcaacagagcgagactccatctcaacacaaaacaaaacaacaaacaaaaaagaaacaacaacgaaaatagtggctttaacattctgatgtaagactccagaaactcacccaaaaaatggccggcgtccactagagggatcccttgcgccaggtcgcctgggtgaacctggtggttgcctgagtgggtggtttgctagggaaggggttgttccgccgggcctgttccccgccccttactgggctggattcctgggcacttttctgtttgttctgctttgctccacctcctgcctcttcccatcttcctccaagccctgtgaatgaagtgggactcggcctggaaaccgtgctgcagagagaagggttttgccccaggtatttatgataagactaggtggagaatccgggcttcctgaaacttgctccactgtgttccccacagcccccttccatgtctctgcactagcagactccctgaaacaggtcacgtgtatcacccaggagagacacaggctgcagcagtggccggaggctgggcatcggctgctgttttgagacattattttgtgtcaggcacaaagttacaaacaaggcacttttacataccttctttatttttcagtccctccaacaacctggtagttggtagtatctccctttgttaggtgtggaaaagtaggtaatattaccatcattccccctttacaggtgaggaacaggctcagagaggtaatgtccactttccccagagccggactgcttgagatctaacctcagctctgccctgcagcacctctgagttttaatttcctcaaagtgctgccaccccttgtcatatggacattgttatccactcagtgtactttagaatccagaatagacctgacgctgccacagacctttcatgtttcttattctcagttttcccatctgtaaaatgaggggcaggaatccatgctcatgtggctgcagggagttggttgaatgagatcataactggaaggttgggggagcaccatacacactaattctcagcttatccttcctgagcctttgggctcttatctcagttatttgggctcttatcttggcttattgtctgggacccagacaatgactttctctttattggctcccagttaagcacctcgaggggtgggtgatcaaggtaagaaaattccctaaacttgctaatttctctcctcttccttctgtccagcggagcgggcactggacacaatgaactttgagatgctcaaaggccagcctattcgcatcatgtggtcccagcgagacccaggacttcgcaagtcaggtgtgggcaacatcttcatcaagaacctggaggactccattgacaacaaggctttatatgataccttctccacctttgggaacatcctctcttgcaaggtagaggatgaagggtgtacgtctttgggtagatcggtgtcaactacctgcctggtagaggggtgacaagcaacacctcactttacagtttacaaggtcctttcagtcaagtttcaggtacagcaagcacctgaatgacagccgttctttcagtttcatcttccgtgaatgaccagacattacctgtgtatcagtcagctctcgctgtgtaaccaccttcaaatttagtggccgtcaacaacaatcatttatttagctaataattccacagttggcaatgggcaaagttcagctgggcagttcttctggtcttggctgggttccctcctatgcccactgaaagctgagtgggagctctcgctgggtatatgagggagcgactggctgtcagctggaacatcttggctttcctccctatggccttttgtcctccagtaggctagtccaggctattctcatggtattctcatggcaatggcaggggctcagaagacaagagtggaagcacaccaggcctcttgagaactaaatgcagaactggaaccatcacttccactacgttttttttttttaattgagatgcagtcttactctgttgcctaggctggagtacagtggcatgatctcagcttactgcaacttcctgggttcaagcctcctgagttcaaacgattctcctgcctcagcctcccgagtagctggaattacaggtgcgagccaccatgcctggataatttttgtatgtttagtggagacagggtgggtttcactgtgttggccaggctggtctcgaactcctgacctcccaaaatgctgggattacagccatgagccaccgcacctggcctctttcactacattctattgaccaaagcaagtcacaagaccagcccacattcagagtgagaggggagtagaaattataggatgaagggtgtggctacaggaaggccattaattggggccatcaaggcaattaagttattgaatcttgtttttaagattgtcttacattagatgtaagttccatcagtgatcttgttcttagtcattattgtatcccaatacttagaataagatgtgaaacatattaggtgctcaataaatatatgttgagccagtggaggtatgtcatttgagaaggattctgattatttctctgactttttatatgaggatgttgaggatcagcggccatatagcaggtcagtatgtctggaacagagggcttaaacctgggtgttctgtctctagattttataaggatagttgatcagttaccccgtagcctttggagtgtctgctattctagggaggatggggacagtttttgtagcctatgtgtcagaacttttttttttttttttttttgagacggagtctcactctgttgcccaggctggagtgcagtggcgcgatctcagctcactgcaacctcctcctcccaggttcacgccattctcctgcctcagcctcctgagtagctgggactacaggtgcccgccaccacgcccagctaattttttttgtatttttagtagagacggggtttcaccgtgttagccaggatggtctcgatctcctgaccttgtgatccgcccgcctcagtctcccaaagtgctgggattacaggcgtgagccactgcacctggcatgtcagaacttttatcaagtgctactgtgtgccaagcataatccttaagttctcaacgagggctctcaaattcccagtcaataagaggctatccctgtggctcagaggagcaggtagacttgaggagatgtagtaatgcactaagggttatctgtgacagagagacggggctgtttcctgtctttgaggatcaaaggaagaaagactcttaactgtgtattaagttcttcacaataataatggcagatttatcatgtactttctgtgtgttaggttttctgcatacatgtatactccttaaaagggtacctggcatactgttaagcttctaagtgataactgtaacaatcaaagaattacttctgttggctgaccttggacaagtcatttattctcattttccctctggggctcagaggttaagaaatgactgaaaggattctcttatgactggcatagataacaagggaagtatgtaatgcccttagcaggttcttgacccacagtggggacccagtcaacgtggttaaatccaagctgaggcttgagttgaaagtggaaggcccctgtttcaggatgagaggtggaggggtatgtgcaaggcatgggtttggaagcaagatctgttgtgcaacacccactggggagcctcaaatgccaagttgatatagttctgtggatagaagctactagagattgaagggatgtggtcagaattacattttagaaagagcatcacagtggtagtgtgcaagctaggctgggaggcagtgcttgtcatccaggcagaaaatgccactagctgagctgagcctgtagccacagggatgagtggagccacagtcaccttgaagtggggggttagtggtctttctgcgagttcaacaagagggatgggggctatgtgaactagaaggtctttccttgttctcaagttctgtcctgctggcctgagtcaggagggttacagaatgggaataggatattgtgcatctttaaaaaaattgaggcggggtgcagtggctcatgctcctaatcccagcactttgggaggcccaggtgggtggatcacctgaggtcaggagtccaggaccagcctagccaacatggtgaaactccatctctactaaaaatacaaaaaactagccaggcatggtggcatgcacctgtaatctcagctactcgggagtctgaggcaggagaatcgcttgaacctgggaggcgggggttgcagggagccaagattgtgccattgcactccagcctgggcaacaagagtgaaactctatctcaaaaaaaaaaaaaaaaaaaattgaaatgagtctgttgttgcagtaattcatgtattggcaaagtttaaacaatgtggaagggaagaaagtgaaaaacaagactccatttctttcagccctagtccccaaaagtaatatgaatacattttatgtgtctttttcaaaatttccaatgtgtagatgcctactttagcctgaatggattttttttttcacttaacaagactgtcaggccatgtaacctaccacattctcttcaactgtgcacatacagtagactggtgtacaattgaggctcccccttgatgaataccccggttgtttctagtttgctgatagaaacaaggatgcagatatgggggtttgaatctaacccttttgcccattgccttaggaagacaattaaaagccagtatgcagtatagatgaaacctgtgttcatttcgttctccctcttaaatctgttttttcttttctgtttttatttttttgacacagagtctcactctgtcacccaggatggagttcagtggtgcaatatcagctcaccgcaacctccgcctcctcggttcaagcaattcccctgcctcagcctcctgagtagctgggattacaggcacccaccaccacatctggctaattttttgtatttttaatagagacagggttgcaccatgttgtccaggctggtctcgaactcctgacctcaagtgatatgcccacctcggcctcccaaagtgctgggattacaggcatgagccactgcacccagccttccttaatccgttaacttgagtggtgacactctttgagcttccataccccatccctaacatgcaggattgccttttccaggcacagcaggcatgcagagactggtcgtgatcacctttgccattcctttctacctgaaccctctgtcagtactcttcctgtccttcctccctgtggcccaggtggcgtgtgacgagcatggctcccggggtttcggctttgtccattttgagacccatgaggccgcacagcaggccatcaacaccatgaatgggatgctgctgaatgaccgcaaagtgtgagtggctgggcccgagggaggggcggaggctgcagggacagaagcatggcaccaccgactaggaatcgatgctaccctcaagctgctaatgggcaccaggcacttgagcggcaggcagccctcctagaagtgtgagcccggagcagctgctcaacctctcagggactctttcctcacataaagatggagctgatgatctgcattagagtatggtaaaggaagtggtgattttaaaactctagagggactggctaatggtcatatcatcaatggactcagtgttttcatctgttttccagccttctcagtatggggtgtatgtgtgtgtgacagggtcttgctatgtagcccaggctggagtgcagtggcatgaacacagctcactgcagccttgacctccttggctcaagtaatcctcctgtctcagcctcctttgtagctgggaccacaggtgaccacatgccaccatacctggctaattttttgatttttttttttttttttgtagagatggggtctcactttgttgcccaggctggtcttgaactcttgggttcaagtgatcctcctgcctcagcctcctaaagtgttaaaatgctgggattacaggcatgagctactgcgcctgactttttctttaaaccttttgtgtttcatgagattttggcagaaagaaaagtaggcatatgctaagcctgccctcatcatactgttaacttcgatatcatccccactacacagatgggaaaactgagaggcagataatagagagaatctgcctctggctgttccctgcccagaattttgattttgttcatctgagaggccagctcacatggtcagggccatggagagaaggtggctttgagctgggggatgcactgagagtcattttgtccagggttactcagaggagggtccagtcaacctgtcaaacaaatcttggtgggcttttcccagttctcagaagaatgctcttcgttagctccaatttactcaagttcacctttgccactcagttttcttcaaattttggtgcctggtacaactttgtttgtgctaaacgtgctatagataccatcagaatttattattatttttttaatctgggatgctttcctagatgtgtttacatgaacttggaaatgaacttttaaaattaatcttgtgactgggtgtggtggctcacacctgtaaccccagcactttgtgaggcagaggtgggtgaatcatctgaggtcaggagtttgagactagcctggccaacatggtgaaactccatctctaccaaaaatacaagaattagccatgcgtggtggcacatacctgtaatcccagctacttggaaggctgagtgaagcaggagaatcgcttgaacccaggaggtggagcttgcagtgagctgagatggcaccactgtactccagcctgggcgatagagcgaaactcagtgtcaaaaacataataaataaaaataaaattaatcttgtatttaagtgattttagtcaatgccccccatagcaacactagcattgactgcgtctaattcacttacccctgcttccccagtgcacccaatacatgttaataagcaaagccccatgatgagaatttgagtcccaattttacagcaatgaactctgaggctcagagaggttaagtagcttgcccagggtcacacagctaggcaactgcagagcgaggattcaagcccttgtctgtctgactctcaggctcattcttctgtgctctcagctgcctggtatataatagtaattatgtgtgcatttgtcgcaagaatgaaatcttcttaaccttctgctggggacaagctctggaacataatataatatcttggctattggaggtagccgggccttggggatgttctaaggagtattgtcctgcccagtttcctgatgagggatatgtaagcctggagaagggcagcagttgagcaggagttggcatgggggtggctgatggctggtagctgtccacagccatgagccagtgtgtcatgtccacagctttgtgggtcacttcaagtctcgacgggagcgggaggcggagctgggggcgcgggccctggagttcaccaacatctacgtgaagaacctcccggtggatgtggacgagcaaggcctgcaggacctcttctcccagtttggtgggtgtgtccccaagggagcggggggatcactgtttttcctcttcccttccaaagtctggtagggaggaggggctctcctggggtttcctgaggacttcccagactcccctttgagccaggttggtcctttgcagggaaaatgctgagtgtgaaggtgatgagggacaacagcggccactcgcggtgctttggctttgtcaactttgagaagcatgaggaagcccagaaggtaggagcctccccatggctctgttctgcagcagggggaccgagctgggactaagaagagggtcccagctgcctgtggaggggaagaaagtccctccccggcctaagccaagagggtgggagagtcctgtgtgcaggcaaagcccttccttctgtggtcaaaggccaagggcttcattctttggtcacttctaagccctgatgtccgcagagctgaatatttaggtagggatgcagaagtcattattatataaaaatatttactcatgaactgaccacttaaatcagtttccaccgggtgtggtggtgtgcacctgtagtctcagcctacgtgataggctgaggcaggaggaccccttgagcccagtggtttgagtccagcctgggcaacatagcaagaccctgtctctaattttttaaaaactctccagatgtgatggctcatgcttgtaatcccagcacttggggaggctgggtgggaagactgcttgagttcagttcgagaccagctggacaaaacggcaagatgccatcttcacacacaaaaaggctctcacagttagcaaagaggattattttgtgccttgaaatccaactcaaagtaaggatgttgatgatgctgtcatgccattatgagagaattatgcttgctactttgttcaaattatccatgtgtagttgcagttagaacctaaatttttttaagttctttaagttcttttttcagtgtagttttaagttcagagcaacgtttagtggaagttatggaggttttctgtataccccattcccccaacacatgaacagcctctgccattatcaatgtcctgctcccaagggttacgtctgttacaagtgattcacttactttgacacatcattaacacacacagtcccaagtttacattaggatttacttttggtgtagagtctaggggtttggacaaatgcataatgacatgtatccactattatggtatcatgcagactactttcagtgccctaaacatcccctgtgctccatctgttcattcctccatgccccttaacccctggcaaccaatgatctttttgcttgctccatagttttgccttttctgggacagagactatgtcacctagactggcttctttcacttagtaatacgcatttaaaatatgggaatatataaatatttacattttattttatttttatttatttatttttgagacagagtctcactctgtcacccaggatggaatgcagtgacgtgatctcggctcattgcaacctccgcctcctgggttcaagtaattctcctgcctcaacctcccgagtagctgggactacaggcgcccgccaccatgcccggctaatttttgtgtttttagtagagaaggggtttcaccatgttggccaggctggtatcgaactcgtgacctcaagtgatccacccgccttggcctcccaaagtgctaggattacaggcgtgagccaccatgcccggccatatttacattgtaaatatgggaaaatttgcaaatctcaattttatttttatgtttattttattaagatggagtctgtctgtcgtccaggctgtagtgcagtggcgtgatctcagctcactgcaacctccacctcccagtttcaagggattctcccacctcagcctcctaagtagctgggattacaggcacctgccaccatgcctggctaatttttgtatttttagtagagatggggtttcaccaagttggccaggctggtttcgaactcctgacctcaagtgatccaaccgccttggcctcccaaagtgctgtaattaccaggtgtgagccactgtgcctggccatcaattttgtttcttaaaatacagccccagtccgaattttttttttttttttgagatggagtttcactcttgttgcccaggctggagtgcaatggcgtgatctcagctcaccgcaacctccacctcccaggttcaacgattctcctgcctcagcctcccgagtagctgggattacaggcatgtgcttccatgcctggctaattttgtatttttagtagagacggggtttctccatgttggtcaggctggtctcgaattcctgacctcagatgatccgtccccctcggccacccaaagtgctgggattacaggcatgagccaaagtgggtatacttaaatggcctttgtcctggtactgattattctcagctagtgtggccagcctggtttgcaggtggcccctctagatccagaagatgagcctgggccagggccacatctgagtggttaccaagcatgttccctcctcctttccccaggccgtggtccatatgaacgggaaggaggtgagcgggcggctgctgtacgcgggccgggcccaaaagcgcgtggagcggcagaatgaactgaagcgcaggtttgagcagatgaagcaggaccggctgaggcgttaccaggtgaggtcaggcttcctggtggcagccacttctgtgtgagagcagctgtgtgtcgggggccctgagtggtgactgtttcttctagtgatcctacttctgggcacttggctcaaggcgggaattgaatgagcatgggatggcccccactgcctaatgtataacagtgagaaactgcgcacaacccaactgtccaaccatcataggggttagtaggggtgctggggaccttttggttagaataatccttcacgtgggactggttagcatcccacccagcccactcaatcccagttgcatcctctagtctcagacaaccaaagtaccccgcatattgccagatgcccctagaggaaatcctactcctggctgagaataatcaggccaaatatgttacatccaaaagttggaatgttggacagcctttgaattatgtggagttaataattaaagtgaatattgtggatcagtgcaatttaaaacttcattgggaagtgaacccctctaagattttatttatttacttattttttgagacagagtattgctcttgtcacccaggctggagtgcag[131 bp omitted]tcaccatgttgcccaggctggtcttgaactcctgaccttgtgatctgcccgcctcagcctcccaaagtgctgggattacaggtgtgagccactgcgcctggcctcatttttgtatttttaatagagatggagttcatcatattggtcaggctggtctcgaactcctgaccttagttgatctgcccgctttggcctcccaaagttatgggattacaggcatgagccaccacgcctggccccctctaagatttttcataaaagttctagatccttcatggagaggggcatataaatatacatatccacacaaaacacgcacacatactcagtagttctcagtgaggagcagttttgcctcctgggggacatttggcaatgtctagaattttcattgtcgtgtgggtggtggggtgctactgtcatccacagggtagaggccagggatgctggcaggcatcctacagtgcccaggacaatgccacagcaaggaactgtctggcacaaaatgtcactagatctgaggctgagaaacacatacatcctcttgtgtacatacagcgtgtccaggggctttcatacctgcagaacaaaatactcatcacataatctgcaagagcaggatgctatgctgtacaattgtgcggtctctgttctcttgtacattcatacactgttgtgtttgggaggtctggaaggagaaaagtcaaggtgctagaggcagctgtcactcaacagtgagatgcacagactctgaagttagtctgcctgggttgtcctgtctctgccacttagctactgtatgatctggggcaacttatttagcctctttgtgtttcagttttgtctgtaaaacaaggataaaagttttcttcacgcagggttgttgtgaggattaaaaatcaaaacgtggcctgtcgtggtggctcgtgcctgtaatcccagcactttgggaggccaaggtgggcagatcacctgaggtcaggagttcaagactggcctgaccaacatggagaaagga[142 bp omitted]cactccagcctaggcaacaagagcaaaaatccatctcaaaaaaaaaaagtcttaaaaaaaaaatcaaaatgtatgggaaagcttagagtggcacctggcaccaacatgagtaagtgcccgaggttcctgggctggcaggggatggaggggcagctcacctgtgttagggttctggtcatgggccagccagggaggagctctgactcctgctgcccgacatccaccatctggagagcttggcttgggcatgctctgcacctcagcctgccacgggacctgggacatcctcgtgggccccatctgtgaaatggggaatagctgtggtgaggctgggaccagtgcagatgtgtgagaactgcaggggaatttgggatgtgggggctacagcttgcatgtgatgggcacgctgagggatgggggtacctgggtgctgagggagacggggagcaggaggctgggctggtggggctccccatgccccttgtacctgcgtcagttccctgatctccccaaggcagttggggcttggaggagaaggggacatccagcagtttcccttccatcccagggtgtgaacttgtatgtgaagaatctggacgactccattgatgacgacaaactgaggaaagagttctctccctatggagtaattaccagtgcgaaggtgaggactgggggcacctccgggggacagcgttcccctccatcctctcaccaccatccccccacaaccccacccctccaccctctcgcccagcagccttcagggggttggtgccggctaccccttctggggctctgctgaccccgttggagcttgtagccatctgcagccttgtctgggctggaggggaagagggtagaaatatagtcccagtcacacagctggacttggggctcactgtcaccttggcatttattgagtgcctactgtatgccagattccagaaattcatatcttagtatttccattgacttttgttgtctggcctctgccagtgacattaccctcctgggcctccgttttcccatctggaaagtgagagggctggacttcgtcattcttcatttgttcttccctatttctggagcaccaattgtgtgcccaaccctgttaggcccctgagatgtggcaactggcccatcagcagctctatgagctttagcagatgttgtcttatagataaggacactgggctcactggatggctttccgaccctggcttctcattacaaccccctgggcaattcttaaatacacacacctcagtcaggcatagaatgtggatccccggggtagggcctgggctttttattttttttttttaaagctcccagaggctgggcaatatggctcacgcctgtaatcccagcactttgggaggctgaggcaggcagatcatgaggtcaggagatcgagaccatcctcgctaacacggtgaaaccccatctctactaaaaatacaaaaaattagccgggcatgatggcacgtgcctatagtcccaggtattccggaggctgaggcaggagaatggcatgaacccaggaggcggagcttgcagtgagccaagatcgtgccactgcactccagcctgggcaacagcgagactctgtctcaaaaaaaaaaaaaaaaaaaagcgcccagatggtttttaagatgatgatccagtgtttcttcattctatacttaaatacctgctgttttaccaggctctgtgggaaacaggagcaaatcagatgtgatccttgctttcaagtagcttatagtctagtgaggaagtcagcccgtcactaactcaaatggattataagatgggggacagtatgggaggcaaagctacaggagttcagtggaacagaagggaaggctgcctggaagaagtggcagtagcagcagtgtttgacttggctgtgaggaggtagggagctggagtgggaatgaggaattttccaaagagatcagtgtgagtgacaggatggggggacccgcctgaatgatgtgatgttgggttctgaggaagtggtctagaagttctcttttggctactgagtccagttgtaaacatccttcagggagccttgtgtttggaggaaaaaaggttgtcttttaggttaagatccttttgaaaaatgcgagagaaggctgtggcacatgtaaattaggcatcagtaaatttgattacacatcataaaaagctataggtcctctttccaagcaaatgcatatacatttgatgtagaaacatggttgaaagctggaattttaaagttaatcaggtttaaatgtaaaccccagtcctaccattacctagctgtagaaactgaggcaagtggctttgcttttcggaccttgtttactcacctataaagtgggagcaacatttctcacctctccaggtgtcctaagaactactaaagaggctgcatgtacagcatctgcattcaataagtagtgaaatagtgattgtcgtaatgattcatcatacaccttgcatacagcttcaggagatggaccttcttgaggactccccgaacaaaggaaatgtgtaaatttggattgcttagagttaaggcacacctggggtgaccatctttttaacaggacaaacggtataaaatggggattataaatatatctattttttgtgtgtgtgatggagtctagctctgttgcccaggctagagtgcagtggcgccatctcggctcactacaacctccgcctcccgggttcaagtgattcttctccctcagcctcctgagtagctgggattacaggcacctgccaccatgcccagctaatttttgtatttttagtagagacggggtttcactgtgttggccgggctggtctcaaactcctgacctagtaatccgcccgcctcagcctcccaaagtgctgcaattacaagaatgagccaccacgcccagcctacatatatatatatattatacaattatttatttattttgagatagagtttccttcttgtcgcccaggctggagtgcaatggcgcgatcttggctcactacaacttctgcctcccaggttcaagcaattctcctgcctcagccttctgagtagctgggattacaggcgcccgccaccaagccctactaatgtttgtatttttagtaaagatgaggtttcaccatgttagccaggatggtcctgaactcttgacctcaggtgatctgcccgccttggcctcccaaagtgctgagattataggcgtgaaccactgtgcctggcctatgttatgcgattttatatattttggtttattattattttttattagatgcaggttcttattctgttgcccaggctggagggccatgatgtgatcatggcacgccacaacctcaacctcctgggctcaagtgatcctcccacctgagcctcctaagtagctgggaccacaggcatgtgccaccatgcccagctgatttaaaaaaaaatttttttttggtagaaattgggagtcttgctgtgttgtccaggcttgtcttgaactcctgggctcaagcagtcctcctacctcagcctcccaaagtgctgggattataggcatgagccactgcatctggcctgtattttgttttatataaaaataattatgaaaattaaaggaattaatggatataaatacttataccactatcaagttcatggtaagctctgcataagtgttagctttgctaaattttatcattattaactaccgactgccagaagttcttaacaatatatatatatttttttttttttgagatggagttttgctcttgttgcccaggctagagtgcaatggtgcaatcttagctcactgtaacctttgcctcctgggttcaagtgattctcctgcttcagcctcctgagtagctgggattacaggcgcctctcaccatgcccagctaattttttgtatttttagtagagatggggtgtcactattttggccaggctggtctcgaacttctgacctcaggtgatccacctgcctcagcctcccaaagtgctaggattacaggcgtgagccactgtgcccggccctttggctatctgatgaagcctgtggaacccttctaagaatattttttaaaaacttttttgagacagagtctcgctctatcacccaggctggaatgcagtggtgccatcacagctcactgcagcctccaactcctggcctcaagtgatctcctgtctcagcctcccaagtagctgagactataggagcaccactatgcctggataattattttttatattacccaggctggtctcaaacccctgggctcaagcaattcttccgcctctgcttcccaaaaataggcatgagccaccaaacctggccctaagaatatttttaaatgcataaaataagattcttaggtgtacaaaaaaatcatactgaaaaaatataatggtcaaaatactaaagtgaaagcagtatgtgcttcttttattatttttatttttatttttttgagacgaagtcccactctgtcgcccagactggagcgcagtggcatgatcttggctcactacaacctctgcctcccaggttcaagaacctgggttctgcctcaacctcctgggaagctgagattacaggcacccgccaccataaccagctaatttttgtatatttttagtagagatggggtttcaccatgttggccaggctggtctcgaactcctgacctcaggtgatctgcccaccttggcctcccaaagtgctgggattacaggcataagccattgcgctcggctgagattagcaataattaatgtgatatgaaaatattttctttttcttcatgacaaattcatggctaatactgccaggatttttttgttgttgcccatattcataatagaaggaaatgctaatatgaaaataaagatgtcactttttccccaatccatgcaatttccccctaaattgtatccatgacctacctgagggggatccatggactctcaggttaagacccctctactgaagggtagcagagtacagtttcaaaattactgattaagagcgtgggctcaccaggagttcaagcccagccggggcaacaggatgagacctcatctttacaaaaaatgaacaaaattaggcatggtggtgcttgtctgcagtcccagctacttgggagactgagttgagaggatcacttgaggctgagaggttgagggtgcagttgagctgagattgcaccactgcactccagcctgagtgacagagtgagatcctgactcaaaaaaaaaaaaaaaaaaaaagaaaaaaaaaaaggaaaaaaagaagattttaaaaataactctagtccttatgggctgtatgagccaggccggtgtcttcaccctaaaaaaaggttaaaaacccagggccaggtgtggtggctcctgcctgtaatccctgcaccttgggagacctaggtaggaggatctcttgagaccagcctgggcaacatagtgattgctgatctctacaaacttaaaaaaaaaaattagctgggtgtggtggcatgtacctatagccctaactacttgagaggctgaggcaggaggatccctggagcccgggagtttgaggctgcagtgagctatgatcataccactgcactccagcctggatgacagagtgagaccccatctctttaaaaaacaaacaaataaacaaaaagacaaaccctaaatgccatgtgggttggatcctggaagagaaaaagaatattaggggaaaaaagagtgaaattccagtgaagtctggagttcagttaatagcattgtagttaataggagctaatggtataaaatagttaatagcattgcaccagtgttaattttgtagttttgaaaaatgtaccatgttcacattgggggaaactgggtgaaagatatacagcaggccaggcatggtggctcacgcctgtaatcccagcactttgggaggctgaggcaggcagatcacttgaggtcaggagtttgagaccagcctggccaacatggtgaaaccctctctctactgaaaatacaaaaattagccaggtgtggtggcacacgcctgtagtcccatctacccaggaggctaaggcaggagaattgcttgaacccgggaggctgaggttgcagttagccgagatcgtgccactccactctagcctgagtgacagagtgaaactatgtctcaaaaaaaaaaaaaaagatatatagcaaccctctgtactgtttttgtaactttttctgtaaatctaaagttactccaaagtaaaaaggttattttaacaaaaaggctaagaacctcttccccaaattcctaaagaacttggcttggtacttagcagaggcgatagaagcttaccagaacaatgtgttgggttgagtcctggctaacgtatgaaccacaggctgagtgaccccagacaagtcactctttcgagtctctcttatcccggctgtaaagtgggagccgcgatgcctcccgcatcgggaggttgtacatgtgaggtgtgaagacatgtaaagtatctggcatgcagcaggcctcatagatgggggtgcgtgctgcatccctcaaacagctcagtaaacagggtgcacgctacatccctccatcactcctcagtaaatgggggtgcacgctacatccctccatcacagcttgctaaacgggggtgcacactacatccctcgaacacagcttagtaaacaggggtgcacgctacatccctccatcacagctttctcgcgggcctgcccagtgctgggcttagcccatggggaggagggaggcagcgcagccccaggagccttccttccccaccccagcagctcttgtcttgtcttgcttttaggtgatgacagagggtggccacagcaaggggtttggctttgtgtgtttttcctccccagaagaggcgacaaaggccgtgacagagatgaacgggcgcatcgtgggcaccaagccactctacgtggcactggcccagcgcaaagaggagcggaaggccatcttgaccaaccagtacatgcagcgcctctccaccatgcggaccctgagcaaccccctcctgggctcctttcagcagccctccagctacttcctgcctgccatgccccaggtgacggcctgcccgcaactcccaccgcagccttcccccctgccccagcaaggcagagcatgaagactagagttctagggaaatggaggtttctaacttgcttctgccgaggactcattaggaagtctttgtttccctctctataaaagggagagatagtgttagtcaaatggcatttcccagtgagagaagctcgtgaatgttgtgctgaaaaagactcttaatgatccagcaagtttgggaaatgctgcgttaagcaagacctacatttttccttcctcccttccttcccttccctcccttccctcccttccctcccttcccttcccttcccttccctccctccctccctccctccctcccttccttccttccttccttcgtggggtctccatgtcacccaggctggtgagcaatggcgtgatcatggctccttccttcttccctcccttcctcccttcctcccttccttcacggggtctccatgtcacccaggctggagagcaatggcatgatcatggctcactgcagccttgaattcctgggcttgagtgatcctcccactgtagcctcctgagtaggtgggactacaggtgtgtgccaccatgcccagctaatttttttgtttattttaaagaaggggtctcgccatgttgcccaggctggtctcaaactcctgggctcaagcaattctcctgccttggcctcccaaagtgctggcattacaggagtaagccaccgtcccccgccctacatttttttaaaaattaaatttttatttttttggagacagagtcttgctctgttgcccagaatggagtgcagtgacaccatcttggctcgctgcaaactcttcctcctgggttcaagtgattcttgtgcctcagcctcccgggtagctgggattacaggtgcgtgccaccacactcagctaattttttgtatttttagtagagacggggtttcaccatgttggccaggctggtcttgaactcctgacctcaagtgatgtgccctccttgacctcctaaagtgctgggattacaggcatgagccaccatgatcggccctaaatttctttactatctacactattctaccctaagatgccaatgtctactgagactctccaaaacaggcacagattatccagcatttccccagcttagatggtcatttttttgtgggatgcctgttaacatctcccctggatgttaatgttctgaggagcatggtttgggaaaggacctcgtgggacttacaggaagtagaaagatgtcacccattaaaggccaccacggtaagaacattcctctccttttagcagttgcttaagctgcacaagttggagtaagatgtcaccctttttatccaggtcattgggttagctgacagggagccaagattgaaatctaagatctttgccctgcaggattcagggctaatggacatcctgagatgggaggaaggagctttcattacagccttgtgggtcttgactcaccagtccctgcaggagccagtggagttcctgccatggtgtccctgaggaggtgtagcttctcacctaccctgccgccaagcccctcagtctgggtcttcttttcccatgcagcctccagcccaggctgcatactatggctgtggcccagtgacacccacccagcctgcccccaggtggacatcccagccacctagaccttcctgtgagtgacccagccccttccactctcagactggcctattggtgtgggccccgtgaggcagtcataacacagggatgaaacctggctctgccacttcccaaggtgggtgacttcacttctctgagcctcagtttcctcttctgagcatgggcctgaatgagacgtgtgtaaagtaccaagcacagtggtgagccaatggaagacacgcagctagccaccagcagtcatcaccaaagatgcctctgatttgtgactctgaaaattcttgcaaagctgagaaggtgaaattcctctggctatattgttgaccaaaggccctcctctgtaagagtgaattgcacgctcacttgaaactatcttgagggactaaggtgtacaatcctggtgcttatgcagtttggggctctaggtagacacgagctggctttgaaattgtagattcctacactccccctttctggagttctgggtctaagtgaattgactcctatttctgttgtgaatgttgtagtttcccttcccattctcttggtggccctggaagcttctaggcacagtgtgccaccctgattattcccaccactccatccaacttttctctctctgtggtgtctgcaccacaagctgcctaccctccaggtgcctcaatggtccggccaccagttgtgcctcggcgccccccggcccacatcagcagtgtcaggcaggcctccacccaggtgccacgcacggtgcctcatacccagagagtaggtgagtgtgggtagggccaaggggaatgggggtggggcaaagttggcactaggagtcaggaccagcctccatggtgaccttgccatatgccctctcggtgagcaaagctgactttggagactgtagcgtggtagttagcttggcctccagttcctgggaccaactgactatgaggcccttgctgactactatatctgtcacctaatctttaaaatggggacaaaaatagtacccccattttattgtagagaatttaaatgtttttttttttctttttgaggcagaatttcattcttgttgcccaggctggagtgcaatggcatgatctctgctcactgcaacctccgcctcccaggttcaagcgattgtcctgcctcagcttcccaagtagctgggattgtaggcatgcgccaccatgcctgggtaattttgtgtttttagtagagacggggtttctccatgttggtcaggttggtcttgaactcctgatctcaggtgatccgcccacctcagcctcccaaagtgctgagattacaggcatgagccactgtgcccagccttaattttttttttttttttttttgagatcgagtcttgctctgtcgcccaggctggagagtaatggtgtgatctcggctcactgcaacctctgcctccggggttctaagcgattctcctgcctcagcctcctgagtagctgggattacaggcatgcgccaccatacttggctaatttttgtatttttagtagggacagggtttcaccatgttggccaggctggtctcgaactcctgaccttaggtgatccaccagcctcggcctcccaaagtgctgggattacaggcatgagccaccatgcccggcttgttgttgaggatcaatgagatcatgcatgaaagggcttagcactgggcctaaagcctggtaagtattgcagtgactataaacaagggtgtaggttttggctgtacagcaagcacatctgttctttcattctgcaaatgttctcacatccacagtgtgctggggccccaagctcagcactggaggttctgcgtgaacgaggtatactcagtctctggccttaggttgctgccaggccctgacacccctgcttattcctttttattgtggtaaaatacacataacaaaatttaccacttaactatttttcagtgtacagatcaatggcattaagtatattcacactgttgtgcactgtcaccaccatccactctccagaactctgttcagcttgtagagccgaaattctgtacccatcaaaccataacttctcgttcctcctcccgctagcccttggcaactgccattctactttgtctctgtgaatttgactgttcttgcttggtacctcatgtaagtagaatcatagagtatttgtctttttgtggctagtttttttactttacatgtctcaggatgtatctatgttgtggcgtgtgtcagaatctccttattaaggctaaataatattccattgtatgtatagacctcatttttacttattcattcatctatcaatggacacttttctaccctttgggtattgtgaataatgctgctgtgaaaatggttgtgcaggctgggcgtgatggcttacgcctgtaatcccagcactttgggaggctgaggcaggtggatcatgaggtcaggagttcgaaaccagcctgaccaacatggtgaaaccctgtctctactaaaaatacaaaaattagccggacgtggtggcatgtgcttgtaatcccagctacttggtaggctgagacaagagaattgattgaacccaggagggggaggttgcagtgagccgagataacaccactgcactatagcctgggtgacagagcaagactctgtctcaggaaaaaaaaaaaaaagaaagaaaatgtttgtacaaatagctctttgaaaccctgctttcaattcttttgggtatatacccagaggtaaaattgatggatgatatggtaattctgtttaactgtttgagaaagccctatactgtttttctgtagtggctacatcattttacattcctaccaacagtgcacagtcttctaatttctttacattcttgtcaacgcttgttattttctgttttggtgttgttttgttttgttttgtttttggatagcagctatttgaactctgctttttttgttttgttttgttttgttttgcagccaacattggtactcagaccacaggacccagtggggtaggatgctgtacaccaggccggccgctcctgccgtgcaaatgttcctcagcagcacatagcacctatcgggtaaggccagcccagctgcctgctcttagcctgggctcctggccgcctggctcagaaccttagctaaggtgttgggccttggctttttttcttttcttggcttgtaaagtttcgtttattaatgtgtacaatcaataagagatcacccttactgcgagaaggggaaagagggccagcattacgttttatttacaatttgttttgcttcggttattaccaaaattaatttggatatccttagtatttgtgatgaacaccaaggaaaggtattctaagaatatgctgattattgaagggatgtacttaatcttcaaaacagaaaatacttactgtaatcaaagactgtgtatttatctccctcccctaaaaaaggcctaaaattcagcattatcatatcctgtgtagaatttcaatgtgtctcttttgaactatttcctgcaaaatgaatgagaacagtctttaaacagcaaaaatgtctatttttttttttggacagggtcttttttttgacagcacccaggttagagtgcagtggtgtgatcatagctcactgcagccttgaactcctaggctcaagtgatcctcccacctcagcctccaagtacaggcatgtgacaccatgcctggttaattttgtgtatttttttgtagtgacaggggtctcattatgttgccaaggctgatctcaaactcctggcctcaagcgatcctcccactttggccttccaaagttctaggattataggtgtgagccaccacacctggccaaaatgttttaaaattaccaagatgtgaaagggtgagaggtgtgccggggacatgtccataaatctacttgataaaaagtgctttatttggcacaaagttattggtaacacagggctttcctttatcaacgttcatcagggacctttataagttcgtagcactacaggaaacgtctaagctagaggcatgactttgtcttctaatccactttgcccttgttggggactctccaccccacctgatcatccagaccttgccctctgttcccctcctccagtgcctccctggccttctgctcacttgccagggtaagtattttgaggacatgcctgtccatggtgattaagggatgtgtccccggcaccatgcaggtccaggagccggctgtgcacatcccaggacaggagcccctgaccgcgtccatgctggctgcggcgcccctgcatgagcaaaagcagatgattggtgagtggctggttctcctactgtggagcaagaagaggagggctgcgagctggctagcctgctgggaaacacctcacctggtggtccaacgtgaggtcaaattccagctttgtcaccgacccccctactgggtgaccgtggccaagctggctctattctctaggcacctgttatcttgtcttaaaacgctggtcagactggatggtcctgagctttcttccactgctgctgtcctgtgactttgaggttgggagacagtccagatgtggggagatcaggggacaaagggaggagtaggggtatggtcttgggtttctgctgagaaatggcttgtaggtggggggttaaagttcctcacacctctcctgaacgggaggaagctgctgttcaccagtttccagtgctcaatgcgggcaggtggggcatctgtgcgtttggtaaatacatgatgtttcccatagattctggattccttgtgcaattcatcttcacccctagtgtccatggcaggccctgataaaaatgccactaagtgaacacaagcttgttcctggttggcaggttctttactgcatggcccccgagacctccagaccctttactgaaggcccccattaccactgccccattgtttcctcagcttacttagggttttgccacattaccccttcccctcaccccgaaatttttttttttttccctgagatggagtcttgctctgctgccccggctggagtgcagtggcacgattttggctcactgcaacctccacctcccgggttcaagtgattctcctgcctcagccttctgagtagctgggcttacaggcacatgccaccatgaccagctaagttttgtatttttattagagatggggtttcaccatgttggccaggctggtttcaaactcctgatctcaggtgatccacccacctcagcctcccaaagtactgtgattacaggtgtgagccaccatgcctggcctcacccagaaacattttgaatgagcttaatggaagtagaagtctttgttagtagttctctgtaaacattttcactttcttcatgggacgatcctttccgcccccacttaaggcacccagtcctggctgggccctggacacattgctgagatgggctgaccaccaataccaggcccagtcattaaaagtacctgatgttagaagatcaagtgttaaatgtcatagcctagaaggagcagttctgggagaagaacccagatgtcctcagtgctccactccatacgagccctgggatgctggggtgtgagctaggccgtgcacaagccattagaaggtgttccacacaggggagcgtctctacccccttatccatgatgtccacacccagctggctggcaagatcacgggcatgctgctggagattgacaactcagagctgttgctcatgctggagtctccagaatccctccatgccaaggtaagcaggagcctgggcagcagggagcccgagggggcaggaggagagctaacgacaagggctctcctagtggagccagtggatagctgtttggccagataaagtgtttcttcttgctaatacctgaaggcctgctgaatcttaagagtggaaggggccttaggtaagggtttgctacttcagcccttccgtagactaattctgtgttgttctgtaggtaggtcttttggtacaaggaagtgtgttgtgactcagtgtaagggttaagatttttccagctgtccagcaatgtacctctgtgtcaaaggtgacagacagggccatgggatcttgcaagcagtggtggatgggagggttccacagaaaccctgtggatggaggaggatcctgtatccaggatggtgagcgagggggagatcaaggctcttctgtgacctgctaagatagctgcactaagcccccccgccactcatgtctcacagatagacgaggcagtggccgtgctgcaggcacaccaggctatggagcagccgaaggcgtacatgcactgaaaccaggtgggtggaatggtgacagaagcagctgagcccgggagaagctgtaaggaaataggcagggactgactttcacaaacactgagaattgcgccgtgttcctggctttctctgaagcaccaaagagtttggaggaagttgtgagaatcagaggagatgattaactgtgatcggaatggggggtggtggagggtgaaggaggtgccctcttgccagctgccctgcctggcttcatgcagaatagtttgggctttcccagggccctgcctggctccattctgcctgcctgaaggcctggccaggatgtaaccaccttctttattgaagactgggtgtctgccatactttaaaaacacttatttttacctttttgtcctcagaaaaggaaatcctcgcttccatggctgccaaaaggacagtgtttctggctctcagccctaaggccctgcaaactctaacttatttcccaattagtctgtatctatacttgggctctgtatgtgaatgaaggttggtcacccatccagcctattaccttttgctttgtgtattaaaagtgctgcaaaatctgccttgcctcccaggaggcccttttgtgtctgagggaggtggggacagagcaaacggtagacatgactggggtggggctcaggctctaagaaacagaaaccctaaaggagtgctgaagtacacagagggcatatacacaagagcaggagaagtgttaggaactgacccatcaacagtacagtggatgatgacatggatatcacacaatggaccagagctacaggggcccccatctgatgtgcatgcagcccctggcttgggcaccctgcagggcaaacacccagctgcttctcggctggctaaggggttgtgtaacataattaacccttgtaggaacgttttagggtaccttcccaggtcaggattttcctcccctaatggagaagtctctcgaaaagcttctttgtgtcagttagtgctcacctcccatcagggacgtacagtccaggtctttgccctctcgtgtaccggagcggcccagtgaaagtggctactatgacccaagcagactgggttctgctaaaaattcaccagcaacaaatctgaccgagtcctcaaggctgctctgccactctcagcaactcactcttcctgttctccgctccacagacctccaacctgtcttcaccatgtcctgcccacttctttggctgcttttaatctgttccctgtgcagctccatcgtcttctccccaaatcctgactgctggcatttctttactctcagtcctgggccctctcggtttctcatgccatgttctcctgagctatctaatttacaagcgcatcttccatttgtacccagtcgaggatgactccctgtttttttcttcagcccagtcaactcttaagagcacctgagtcacctctcttacattccaccgcctacctgccatcagctcctggttatcttggtaacactcatgtctaaattcaagcttatgatttaactaagtttctttctttttcattccttggttcttttttttttgagacggagtctcgctctgtcacccaggctggagtgcagtgacgtgacctctgctcactgcaacctccacctcctgggttcaagcagttcttttgcctcagcctccagagtagctgggactacaggtgcactccaccacacccagctaatttttgtatttttagtagagatgaggtttcaccatattggtcaggctgatctcgaactcctgacgtcaggtgatccacccgcctcgggtggggtttacaggcatgagccaccgtgcccggtcttattctctgattctctcttccagtgttctgtctccataaatggccccaccattctgttgcaaaagccaaaatcagagggtttccccagccctgctgccacaccactttctctcctcccctcttccagagaaaatccaccaacatgacctcctaccagatccaaatccactaccactacctagtggaataaatccactaatttgagctaagctcaacccctgcgctcactgccttctgccagttaactgcatttaccctggccctcccgcagtctgtcctccaccatgcagtcctaaggcttctttcaaaatgcctctctaatgtctcatccttgcataaatcctgcagtagcttcccatcattagaataaggactactttacacagcctaggagaccctgcatgatctgctctctgccctgtcattcccacgtaacggtgttttaccttctctgggagtcggggtagaattccatcatgaccattaagacagtcacattgatagctgtgtgtccctctcctagaaacattaacctatgagaagcagaagttttattcctcaaagcatctctggaaaagactgaatgatgttaaatttcaaagatgagtgatggggatgaggaagcttatgttgtgttcttcagacatttttgaagtacaaaatgagtagtctcttcgggttgtgccggccccaccctctgtgtcttcactagcaaatcaagttgcttgccttctagagctcagaatgatgtaaaccagttgtgactggatgtcacgaaacctgcctcacatcagtcctgcctgcttatgaggcaataaaaggggtacggtgccccactttgaaactgtcccttgactgtgccgatggggtttgtctgactctaactctgcttcagcctggatgtctgtgatggctcagacaacagactcatccttaagagagctcagaggtggtgtgcttaacgccgagtgctgcctagcactatgtgatgggagccaagggatgatcagacccctttgtctactctgctctgtggaatcctaaaactctacttccattaggtgaaaaccagcccaggaaagggaggcagcccttgattctagctagatcctagagcactctccagcctcaccccataccatgttttgtgaatttcatcagcccttttaggtccctgtactcactggctgtgctcccaatgagggccttacatggccgttctgtccacggtgtttccctcccctcttcactagttaacctccccatctggaactcaattcaagctttacttactcagggacccccttccctccactgcatcaaatttccccttttgggcagggaaatcactgacgactgcttcacaacactcaggcaagctgcaattttacatgtgtgtggttgtctgattaacttcttgccttcccactggactaccagccctctgagagcaggggctgtgtctattcactgctatctatctatctccctagcactattcacagtgcctggcccatgcagacatgtcaataaatttgttcaacaaatgaatgaatgcccaataagcaataacttttattattactacagagttccaggtgcaaagctgaaaaggcataaatgaaagcacagcagatattgatgtagaagaaagctttttaatgcaacagcttaaacacacagttcaacaaaatcagtcaattcaaattaacttcaacatattacaaagaactatgaagcccggagaaggccactgttggaacaaaaaaccaagtccctgcccagaaagcatggacactgaccaaggaggcctcttgccccctcccacctctaggaggagcagccacaatcactgggctctttaaacagcttaggtgcctctctgcagaaggcagcagcacagagtcaaggacaaccattcaagggtcagggctctgccttcccaccaaaggagggcccgaacagaaggcactggggctcagacataggagactgtgcaaggacaggacagggcagggacagcagctgtacacctggagagactgcagccctggagaaccagctcaacaggctgctttggatcagggccttaggtttatccccctccttccaccccggcccaggagctcaggttgttcagatgaactgcagtgagttggggtctggggaagctacaagggcagcactcagtctgcagcccacttgggcaggacaaagccaaatgctttgctgatgaggatctgttggtgtgatcagctagctgggctgggggaatagggacagagcttcagcttcacgcttagctctagtggggacctttctggtgcaacaaccatgtctgtgtttgactacactgagtttaatttgaacaagcaaagcctcttacagggtgggaggccatcaagggattgaggagggggcttcagagctcacttggggcatgctgggtttcaggagcgggcacagagcaggtggcccatggcttctctgggtaaggtcaggcaggggttccagttgccctgttgggtttttagtgtaggttctgcttcacttcctgccgcaacttctgtgcaggaccattcctaggctcaatctgtaggaggttgctgatgtctgcaaagctggatttatagtcctaatagaagaaaagacaggagtgtgggggaaggttcccggactggggtggggatagctgctgaggcagcaaagtgttttcaaaccccagcccacaggcctgctctgagttatcctgggcccaggatgagaaggaaaagctgcagatattgtctcagcttggctacaccctgtaaatggtgacactggcataaatctctgtagctatgttgggaccttttggccaggatttttttttaccttgagtgctttgtgggcttgagcccgtctgtagaatgccttcacgttctttccatccagcttgagggcttctgtgcagtccttcactgcttctgtgtactgcttcaggaccaaatagcagagtgctctgaagggaaagaccatttcagaggtttcagtcacgtcttatgggccacccacatgccacgcagtagtttgagaagtgatctccaatttgctgaacacctactctgtgctggttactttatgtcttcttaaatcctcacaacaatcctagcccttttcatggatgaaacatgctggctcagaagggtaaaggaacttgggccaggtaccgccagtattaaggggcagacccaggattcaaataggcgggcgttcgttcatgggactccagatcctgatctcatctagttctatcatgctgtactgcgctctcctatactgagctctttcaagcaaagaaaaggtttcctgaaacttttcccttgacagattaaaaaattatctactttaagggggaaaaaaaaacccaacaactactgaactctaatgatataatgctgacatggggtgaaatgtaaagacgtttgcaatttacttttaagtgcatcaaacacaataatacagaccaacagatggctaaatagtgataaggcaatgtaataatactaattgtagaatttagatggtaggtctatgggtgttcaatgtacaaatctttcaactttcctatattttgaacattttcataataaaatgttggaaaaaagttatgtgcatccatacaatatattctgcatctgtgggttcaaaaaagtgcatgtgtgtatatatcttcctcattcagatctagtccttctctccaaagacagtcactaaaaacaaaacagtcagatgtctgggcgctcattacataagttcatctgttccacctcactgttttcagtgggtgcagggtattcactaagttggatgtagcataatttattttaccaatttcctatcaagaggtatttttcattgtttccagtttgtaaataagtgatgccatgatgaacatccttgtgcaagggactgctgtatccaaagatacatgcattttaaaacctgactggccaggtgcagtggctcatgcttataatcccagcactttgggaggccaaggtgggaaggtcacttgagcccaggagtttgagaccagcctgggcaacatagggagaccccatctcttaaacaaaacaaaacaaaaaaagaaataaaatctgattgttactgccaaaatgctttccaaaaaagctgaatagttattgacagagcctattttcctacaactgtaccaactttgggtcttaaattttcatgtatgccaatatggaataaaacactatctcactgccttagctgcttagttgtgggtaaagctgaacatctttaataagggtttttaatcttttgaaatcaaacttctctaacttttcctttaacgacttctgtaacatttttttcccttcacataagaataccttccccactgcaagatagttaatccatgtgttcttctagaacttaatggtttcgctttttacattccaaactgtgatccactcagaacttactttaaaataagaagcaaggtaggattcaagtttaactctaacctggccaacccaacacctcttattaaataatctctctttgccccagactttattatacaccagattctctcatgtcgttgttctcatttttttctgacttatcatgaatttaaagaagaaaattctactagtcctttgtgattgcatggaattcataaattaacggagagaaaaatcttcttgtaacaacttaaaagacaggcacaaattctttggcaatcctccactgagaggcggaggtgtatctgctctctctctttgaattcgggcaggctctgtgactgctctgaccaacagaggacagaggaagggacacgatgtgacttccaaggttaggtcataataggccttgcagcttccaccttggtctctggaaacactcgctcttggagccttgaactgacagggaagaagccaactactctgaggccaccacgctctcaggaagctcacagcagcacacatgaaaaggctgctaagaaagtggaaagaggtgccagcttgctctagcagttccatcacccagccatttgagtcaggcagcccagctgccagacattcgaggaagaaggctttagaggattccagccccagctaccatcttgctgaccctgcatgagagaccccaaatgagaactgcccttccctaattcctgactccacaaattacaagcaaaataaaatggttgttgtaaatcaccaagttttagaatagtagcccgttttaaactttgaacacagaagaattcctttttttttttggagacagggtctcactctgtcacccaggctggagtgcagtggcatgataacagctcactgcaacctccgcctcctgggttcaagcgattctcctacttcagcctcccgagtagctgggattacaggtgcatgccaccatgcccagctaacttttgtattttttggtagagatggggtttcaccatgttggccagcctggtctcaaactcctaacctcaagcaatctgcccacctcagcctcccaaagtgctgggattacaggcatgagccacctctaaacatagaggaattctaaggaaattaaagtttcctcccaatgggcttggcaatttaaagaaatagccaagtgtctgggaagcagaggaaccaccgtgtatcgtgacttcagaatagaaatgtgattaatagggtcatgtgagacttctaaagactatatttaagatgaacaaaatgcataacttcaggcaataaaataaacccccttgacttttggtaaatgaagtaactgtatccagtcagaagggttttaattacaaaggggttgggaaataacacaagtgagtgaaagggaaataagctttggagtcacaaagatctggcttaaatctcagccaccatgtactagttgtttaactttgtggtcactaattcatctttctgagcctgattaggtaacacaggacaatgatctaagctgaagaactgttgtgagtacaagtgagattcttatgacagctgtttcagggctggcaagttgtaggtgctatgcactcagatgtcacctgcacaaagggagccaaagtaagccaaagcctgggcattgtgtcattcagatgggcgtacatgaggtggagcattagactatgtccaagacgttccaggacatgataaaatgttagccacaatggctgaaagttgttttgtcattagtcctctagattaaattataaatccaatgcaatcacaaccaaaagctgtccaacaagacattttttggaatttgccaaaatgatccgaagctttagctagaagaacaaacatgggaaaatactaggaatgctctgattaagaagaatgaagaaaagaccagccctataagatattataaagcaaaagcaattaaaacagtgtggcacagacacctgcatgaagaacagtatctaaacaagacaaaacacagctccaaatatggtaatgatccagaaaaatgagttaatggaggtgtccagcagcataaggtaagcaatgtgaaagagggtccagagatagaggagttagaagatgccacacaaatatggaacaaataggctgcaggcttctttttcaaattagcctggcaaattgtggcccctctggtccaatcagcaataaaaccacataaaaccacaggtgcaaaattccaaaatataagctttaaaactacaagttctctttccaactcattgggcagcaaaacctgatctgaactgacatgaagctatttagtttctctattccaccccatgtgaacatggaattttcaagtttcactggcagaaatactaataattaacttctgcaagctgccccagacactgctggggtgttacataattcagaccatattacctcactaaaatggaaaacacttcttttttttttgtgacagagtctcgctctgtcacccaggctggagtgcagtggcacaatcttggctcactgtaacctctgcctcctgggttcaagtgattctcctgcctcagcctcctgagtagctgagatcacaggcatgtgccacagcgcccagctgattttttgtatttttagtagagatggggttttgccgtgttggccaggctggtctcaaactcctgacctcaagtgatcctcccggagcctcagcctcccaaagtgttgggattacaggcattgagccaccgtggctggaaaacacattttatctcaagagtttggaataaggaacaatgtgtctatattagatccaagatttttgaactagagagtgatatgtgtatgctggtagggaaggataaacagatttctaacattttataatgttttatactaagcatttggttttgatatggtctcttgctgaatgtttcaagcttctgagagtaaaagtaacaggaagatcttgttgaagtcagattccaattcttgtgccaacatttactggctggctgagtttaaagcaaaacccttccttctctgagcctcaattttctaaacactaaaacagaaagaccacctatacgagcattgttggagaacaatcactcctacacagtgaagggaccgcaccctggctcccaggttctcagtcagtggtcactgacggcagctcctggtgcaggactttctacaggcccacaagtctaacctttcaggctagactgtacccatccttcctgctctcatgccaggcaatggttacttcacattttggcttctgggccagtactctcagacagaaatggtgccagaatttctaacaggagggtcttggagaagggtagggagcagcgtagcgtggtggggtggacaggctaagagacttgtgttagggttgtgtttgcagagcaggcacactgcttttagttacattgcatgcttatgaaaattctggggacaggggccaacaaagcccaggctaccatttggcatccctcagtttctacccttttgagagaatgaatgccactggtcatggctagctcacaacgtggatgcatgttttcagccataacatacttgactaaatgctagggatgaagggcccattgcagtccaagagaagactatggaacaaatgtcctgaaatgccccaggccagcagctgtataggagatacctgttgctgtacgtggcagattccaggttactacacaagaggctttcactgtacttctcaatagctttcttatggtttcccttctttacaagctcattgccttcttccttcagaactctggctttctccacatccccagcagaaggcactagatacaaattcagaagaggaaaaaaaccatggagcagcacccaactgagatcagtgaggtctcttcagcatcgtcccttccaaactgactacaatcctctctcccagagatttcctcccctgctgtaaatcatccttcctgattaatgacttcccccaattaatagcttctgggcaattcaacagtttttcatcaagaagttggggaatcctgatataaaaacatttttgcatgcacataaaaatatataaatgataaaaagcaacccaggttctagccttggcactgcctcttggtagctggaagatcttgtgtgacctacctaacttttggacctcaatttcctcaccaataaaatagggcaatactaattccacagatggctattttcagggtcaaatctgagagtatgtaagaaagtacggaacacactataaacttaaagcaggacaataagtaaataaatactaataaacaaatatctggtaaagaaaaggtatagcttctgggctatgagaaaaggggagaagagcctgctattcctcatttctggtttgggctgagcctgtgagtatcctccctcatctaacacatgcagctctgctccagccttcaaggagaggaagcagagggaacatggtgaaatccaagctgctcaacttggtgttcaggcccttcactgcttggccccaattaattattccagcctcagctccatatcatctgcttttcaaaaatttttaaaactatctttataaaatactaaatatttatgaccagggtaagattataggtttacaccctgaattcattgcctggtttaagaaaaagaacataactaggacctttgaagtcctgggggaccttcctcaattcaatccactgctggaggaaactattatccccaattctgtgcttcttccccacctttttaaacagtataactatatacaacagtacccacagatcatttgctgtttactttgtttttgaacttcatacagaagaataagtctgtgtattcttttatgacttggtttttctttttccccttaatgttatatttctgagattcatctgtgttgatgcacagacctgcagctccttcattttcattgctgcaataccaaagctgaattgtccattctcccatttatggagatctgggttatctccagttgttttttgctattacagtcttctacgaacatttgtgggtacatctccctgtgcacatgcacacaggtttctcttgaagtagggcttcagcttcactggcaccctgcaacacaccactctgcagtcatccttattcctactgttccccccatgcactttcattctccaactctctccactgtctctgccaaggattctccttccttcccacctgatgaccttcttcaaggtccagctcaaggctccacctccattgccaccccttctgagtctttccccgactccctcatgcacttaagtcagtttctatcctgaagtcctcaaacactaagactctaaagcacatgttcctcctccttgtgttttaagacactgtttacatgtctcagtccctcaactgagggagagttccctgagggccaagactgtcctctgtgtcacactgcttagcatacacatggcttggaacacatggctcagtgaccctgaaagaatgaaatcaatggtaggtgcactgatttaaagaatgaaatcaatggtaggtgcactgattgaaagaatgaaatcaatggcactgatgccatcaggttcattagcaccgcacattttcatcctagagaagagtggggaacacttaccaggctcccacaaaccagagtgaatgctacccatgaccagagaggcattctcctgtagaaggtgagtaactcttgtcctcccctaacacctataggtcacttacacatggcagggctccatctctgatcccttctgcacctctagcctgaatccctagcttgctgggctgggaccattcccctggagcattaaaagagcttcctagtgcctgacaaatggcctcttcatttcatacagttgaggtgaggaatctcctgtttttggctgcttggatctcctttctcttcttcatgcttctccagggattcacacagtgtacatgctcctgggaagcatcaccctctagttctggaggtggggcaggtgcctcagggtgacctaatcacaaaatctcatccgccggttatggtgtgtacttcagggaatggcctgtgaccatgaagaccagaatagattgagaaaatgattgagaaaatatgtgagctagagttttttgggggaaaaaaatcctatcttttcctagtgagctatcagagaaagactttctttctctgggtcatgaggcatggggtatggatgtgaggccgggaactgctatagctattttgctactaggagggaagcttgccaaagacaaagctgacgcacaacagaaaataaagctgtgataagtacagaaaaatggagttagtctgttaatatactgagctgctggagcaaaccttgcctgaattctctcggatttttcagttttatgagccaataaattccctatactatgtttaccatgttgagctttctgtttttgcaaccaaaaacatcctaagtactacatcccaagtgctaccagaggaaagagaagggaactcacactgcatgcctatgtgccaggctgggagttttacatgtcttatgtcattcagtcctcatggttgtgaggaagactttatcatcaccctcactatacagctgagaaaacagtctctaagaggtgaagacttgtattttgttttatactttgttcctaagattatttttataactcagctaaacaatgccaatttttgcaggactactctaaagaaaatggatagtgggagattgcaagactctgggcagggagtcacagctcacctctgttctttgtagctgtggtttctttggatttgcttttagccatctctttgtggttctccgaaggcaaggaattccacctcttctgagctgaaacaggcaccaaggggattgagggcagcttcaggcgccactcaggcccaagcgagtccatgagagctctggtcattctggaaaagaaggcaggattgcagggaggtttccagctgggtcaagaagatatttctcctttcacacacccatgggaggtaggccttttcagaagagccagagctgccaccctccccctggtcggaaccacctctttagctcctccaacacgtgcaatacaggaacccataaacaccatctcagatcagtccccatgacattccttgagcttggtcaaactatgttacctttaaagtggtgatctgttgcttgttaaggatacttaaaccatgatccaaaaagactatagtttctccaagaaagaatcatacattttgtttcatattttatcaatgaatcaagtacacaaccatgcaagcacctgacatttgtttaatgctcaggctttttaaaaaatgcaaagcttatgtcattctcaaatcttacaactcctcaggggttcccaattccctaggctaatgtggcatgtgagatctggtccccaccccttcctgtcccccttcactgtgagccacattctcttctgatccttctgttcaagactttgcacatgctttttcctctacccagaacaaccattttcattttggaaaaagattgccaccttccaggcccggctaactccaacttattctttagatttcagcttaaaatgccacccagagaccaagttcattctgtcaactgatctccagcacctggtatgtcacctagcaaccaccaaggcccaatcagttatgtgttgaatgagtgaataatgctaactgtatactttttctgctcctacaaccatgtttcctatattacaagaataaaaaccacagactgtatcactacaaattccaagatgtctctggctaggctgttttcctggcggccaagctatttcaaacctctgctctcctcaaacctgttccctggcccttccccttttttagagcaaacttcctcataccccaaatacaaacctacctgcctgggtgcccaatccttcctatttctctcctgtcacaacagaagagacaatgggaccaatccacccacctaagctctggatcccatctcctcttgcctctttcagggaccacacccaggcagcacctccctctcccacatcttcatccttcctctctactaactccaaccgtcagcatttaagtccctttaactctttcctcacctaataaaaccatactggacaccccttgccatcacaggtatactccccagcttctcttcaagcctgactttctgaaagcattgccctctggctcctgatcccactgaccagcttccatcagagccaccggtgacttcattgccaaacctttaatgtaagctccttggaacacctgacactaatgatgtctccatctttcttgaaatactccttcccttgggacatcaatgccctgtttcctcccacctctctagctgctgttcctctgtaagtccctcaaatgctggagtttctcaaagctccatcctcttcacactagctgtgatgttctttttctttctcacagccctaatccacctctgcgctgatgaccctcaaatccttatgtctggcctgtattttcttcctttgttccatgtaaatacccaaccgtcctacttagatctctagtcttatgtcccacagtcacctccgactgaatgtcaataatctgagtgtcttcttctattcctcccttctcgataccccgcaaccactaaagcttgttgatatacttcctacatgtcccctgactggtcccattgttttctctccaccctctcccctggattgctgcatgactcctttctattctgttgcccttcatatcatccctcaacatggcagcaaagagcttttctctaaaatacaaatctgctcatgttgctccactgctaaagaccttttcataaaggctgacttgctcaggattaagtccaagccctgaaccctgggtcttgtgtgacttggcctcaccaacctgtcccaagctgagctcctgcctgcagcaccatgtgaaaccgacttcttacaattcctgtgatctgtcacacttgctcacctttgcacacgctgctctgtcttctggctaaccccctaccccatatctctcattcttagctcacctcctctgaaaagctctctctggcctccccctctccctctcagctagctaggtggctcctttctggcctcagagccccctgtgctgcctcctaccatggcgcttatcatgttgtattgtgcttgcctattactgactggtgtcttccttgagaccgggacctctatgacggcaggaagaggtatgtctcagtcatcagcccaggtcctagagcaaagtctgtcacataattggtagattttgtggaatcagataagttaaaaaggaggcaaagagaaaacaaagaatgctggcagacaagtcaagccagaaataaagcactaaatacataccatgaagtccctgttaagggtttgctattagtgcagtgtttggctttctagccgcacacgcagaggggaaacatgatcagttatacaaatgacaatatccatgagataaaagccaataactgctcagagaccagaaaggaattgcacctggggaacctcttggattggtcacagtgcaatatactgaaccatgtccacaaaccatatccttttaggcttgtcatagctgcttgggcttgtgtcttattcttctaattagcgttagcgctttgaaggtaagtggggtctgtatctctttctcattttggtatcccccactgaaccgggcacaacaccttaaacagtgtacaataaatattactgtgtacatagatactgtgaggcacatgtaggcaaatatcaatcaatcaatcttagtaattgactccctgaaaacctgctaaataaaaaagcagattttcctttctcagcttcccctacatgcccatcgggagttttttaagtgtagccaaagggatcccctcagaagacagacaaggcaatggcccgcagccaatcaagaaggacagggagttgccgtggagaccacctgctgggaatggagctcacctgttgatgccttctacggctgacgtcacattatcatcaatctgcagcacagtcttatagtcaacataggccatagggtacttctccagagcctcataagcagatgctcgccgcagcaggggcttaatgctgaagggaaccaaggccagtgctctagaataggaggcaaaaatgtcaactggctggctgctgagccaccagggtttccctacagtttcttccaggcagggttatctggagcactcagcgtacaggaagtaatttctggccgagagacatggctaaaaacgccaaacctcagaacagggatttttcaacgtagactgaagtgaggaggagaaagaaggcagagaaacatgaattttgttaaatgtgtgtgcacatgcatcaattttcatagtttcagttcccccaaaatcaagaacaaaagcctcatggctttcatgctactatgtttttttacagttgtggtctagtgggaataacaaacaagctttggagtcagatggggtggtgtctgaattccacctctgctgctaactatgtgacccaggtaaatcactttactgccccaaccctcagcaaccaagttctggcctgggacacatggtaaccgtaccccacagattggttgtgaacactcaaagagggaaatctggcacaaggcatggcacaaattaattcagcacaggctctgtgagtatgctcacacccctcctgctctcctggctatcaccagggcaggaatctaaagcaatgtcagaggacatcagatctgagaacacatttcaggtaaatgtgagagtttaatgatgataaaagaatattagactggcttgaagaaaaagagatatgaaacattgttcagtgtcctctaaaactggtcattcatgaataccatttttttcctttctccttctgagacaatctattaacctctattcctccttctttccttcgctcccttcccctcacatactcccatcccagaaaagcacctgggcaagccagttactggtctgccactccaccttattcccaggtttcaaattgcacaaagactttacggcctgcttctaactgcccatcccactcctttttcggcagcagagccaagactccaaagatgcaagtcacgggccataaggaccaaataaagactcccattctcagtgacctggtgaaactcagtgacactttcttaatatctgtcccagatgtaattgatgggatccttccaaagaagaaacaagccagattaacccagcctcctcttctgagaccctcaggcatcccaaaattacccttggccacttacgaagtgcaatctttgatgcagtctctgcagtttccatccttcaagtgacatgctgctcggttggagtagagaacactttcttcttctgggtctgaagaacctgcccagatagagtggggaagatgatcagtttggaaaatgggtgcctcagggcattaggatacatttcaaactcagagctctttgggccttgtgttaaggcagtagagataactataacctgttcaggcttgttggtctgctgggctggcgtgtttgtcattcttatgtgacagaaggacactgcgctttttgccattcaaagggaaccaagtatttcctcattcactcattccagcactgaacttgataacagacaaaagataaacaagaaatagctagcttctgcctcaaagaaatccatgctgtaactacttgggtttgggtggataaatggatggataggtgtgtattttattacaaaaagcatttaaatccaagaaagaaagaaaaaaaaaaaaagaaaagaaagggagggagggagggaacaagatgataaacgtatgataaatggattgaccaaaagttgtaggggcacaaaacacccatgaaagacatgagactagttttacctggtcaagccagggaggactttgtcagggaaatgataattgagctgggtgtgatgggagtacagagaacttaatcaggaaaaagtcttaagctaccccatggggagaattattagacattcttctaaggcagtccttaccctcaggaatcgcagaggctcaagtccttcactgtggccaccatgatctttatttacgtatttttttttgagacagagtcctgctctgttgcccagcctggagtgcagtggagcgatctccgctcactgcaactccacctcctgggttcaagcaattctcctgcctcagcctcagcctcctgagtagctgggattacaggcactcgccaccacgcctggtagagacagggtttcactatgttggccaagctggtcttgaactcctgacctcaggcaatccgcctgcctcggcctcccaaagtactgggattacagacgtgagccaccgtgcccaaccaacaatgatctttatttttaaagataattttcaaccacttcatacccactagtgtcggccattattttaaaaagaattgaaaacagggtctctttttgaaaattttgaaacatacagaagaccattatctcagaatccaccactagatttagcacgttatattagttcccaacttttttaatttttagagacagcgtctccctctgttgcccaggctgaagtgtagtagcacaatcatagctcactgcagcctcaaactcttgggctcaagtgatcttcccagctcagcctaccaagcagataggactacaggtgtgtacccccaagcccagttaatttttaaagtttttgtagagacagagtcccactgtgttgcccaggttggtcttgaatgcctagcctcaagtgatcctcccgctttggcctcccaaagtgttgggattataggcatgagctatggcacccaacccttaaaaatttttttgataagctaaaactccagccatccccatccttatccctgtgctccctccccagactcacagaggccagtacaatcctgaagttggtatgtaacattttcaagcatgttctacatttacatatatatgtatatatgtatatgtatatatgtatacatgtacatgtatatatatgtatatgtatatatatgtgtgtgtgtgtgtgtgtgttaacaggaaagataccattttatgtctattaaagcatttcctaagaggcatcatattgcctatccttctgcaacttacttttttcactcagtatcctgttgccatgttgatatttgatatctttcattcaataccaacaataacaagcgttttcccctcttgttttgccaggcccagagacggaaagtacaaagactagtaaaatacatccttgcccttaaggagctaagtacccaaaacctgtaatccatcttgagtcaccagagtacggttgctcagaaacagcagtggtgcggtggaaagggcatcaaccctgcgatccggacaagtcactccatccctctgatcatgcgtgcccacctaccacatgaggatatcacttcatagacttgctggaagggttcattgtgttagcctgttccctgagctctcttcgtgatcaagaagactgatcagataaatcaagagacttgcccaaaattacctaggaaatctgtagcagcagcagaaccaaactccggtccttgctaaatctagataccaggctagcttttctatggacccagaattaacccatacaaatgtacaagcttttccagaccagctggggtgagatgaatgaaaatggcagcaacatcaatacctcagcttcttcagcaacttcatcaagtaaggctgccatgaggaagtgggcctaaaggagagttttctagaacaaagaagggggcaaaggagtggcttgaaactgcaaaaagtgcagacaaaaaaaaaaaaaaaaagaatgaaatctggagaggatgtgaggagaggtctagcaaaatgattaaaaatttggacttagcatcaaagtcaaacagatccatattcaaatcgtggctcttccatgtcttcactatgtaaccccgagggagccaatttaactctcttggactcctcctttctaagcattttatccacagggccataataaagatcaaaggagatcgtgtctaaaatgtctagcacatggtaaatcactcaagagatgctagccaagaaaaggaaaaaaaggaaggcggcaaagggaaataggtactgaacggtgactcacagaaaccaggatccaaggctcctttcaaaagtcaaggctttaaccaatgagggtttctgattaagtcaccctggagaaggggctttgggcaaaggtctgcggtatgctgacgaaagctggacgctgggagaactggtaagaatatgctattcttctgtttcaaactctccagtagcttcccatccagcagctttcatgccaagcttccagtttggcatgaaatccgaactccttagcagagtttacaacacctccacaataaataagggtctgccttcctaactgacctcatgtcttcctattccctgccctggctcactatgctttgacccctgaaacacaccatgtttatatcgtcttggagggggggcctttctcattgcagttcacttcaggaccgaaaaccttgtgcgcttggcttctcatcatttagacatcacctcaaatatcacttctttacagatgttgcccttgatctcccactccagtcaactctatcacatcaccctatttgtcttcttcctaaccctgattatcccacaggtctcgtttacttactgactcgcttaagactcacgtcctccccaccgcccccacaagaatgcgctgtccttgagagaagggactttttgtgtcttgttacacaggcggtatataacagctactcaacaaatactaactgaaaaatgaattgctgcgggggaggagggtttagctttcttctcagggctcagaacgaggcctaaataacttaggatgggggccaacagggcagttaacaagcaggtggaaagaaagggccgaggaagtttctggtaggatgccggagtcggaaggggctggaagggtgggagggccgggcaggactgctggccgccgcgcgaggcccgggcggtggttgcgggagttggaggagcaggcccggaggtgagatgggggccggggtcgtaccttgcgcctgcagcacccgcagcgcgcggccgtagagcgcggaggcctcggcgtactggccgttgcggaaactctcattgccggcggcgcggagctcctccacagagtctgggaatttgggggccatcccgtggccaggccggcgagttgggagctccttccttcctcccccgtgtggtgcggcacaccttccgggcgcaagcgccggcggcgaatatctccgcccaacagcgaacccgcggcgagggggcggggcctgcgagacctggaggcccggagcgtcccgccctctgcgcgtgctcggtttggaacttaggctcccttgcacgcggggcggcagcatgctctgggctccctgagttgctagaacgccgtggatgacgcagggaaggaggctggccccgctatcagggagattatgtcctagtggggtccccacaggcaattaactgataagcaaacgaagactctcatttcatgtgattagtgctgtaaggaaaacaaaacaggataatgcaatggaaagtgaccacgtgtgggctattttaaataaggggatgaaggaaggcctttctcagggggtaatagttgagctgagaccagacaagatttagggaatgctgttccagccagagggatggtaagtgcaaaggttccaaggctagaaagtacctggtacctagtgctctatagatatttatttaataaattaatgcacaggtggattgatggtgtcaaagtcaacatatagagatgaatctctaaagtttaaatattttatttggcaatcaagaattgcaattcagggcttacacacagaccaggttgtctttggtatgtcagaagaacaaagagaaggtttggagatttttataaaacagaaatgttacatattgctcttcaaggaagtttacaggcactagtaaagtgggggtttatcagcttcttggggagctggcaagctttgattggtaagtgatagtggtggataaaactcagaattgtagcaggctgtttcagtagctattagataaaactggttttaggttacagcaggcagttttagcagccaggcttgcaaaaaattacttttttggagcaatgttatatgccctgagtatttgttcccctggcttttcaattctgtcttagttggatatgacaagaatgacccaattcgtatgatcagctttcagaatggatgaagatctttcacagagtgtgacttcaatttatctccagcctcatctgacgactctatgtcccacgcattgctatctacacacactaaattcttgcttcctagcctttgcttgttatctccttctcctggatttttttttctaaatactttttctcctgcctaatcctgaattaacttataacattccattcaaacatcatcttctctgaaagcctttcctgcttccagccccctccccaccccccactatgctccctttgctccctattggtctctagctttatccctaactttgcattagtcaccctttgattgccagtttgtagttttccttaaacactgcgaggtctttaatggcaggaagtgggtcctttttatctttgtttatccaagaccctaatagggtctggcatccaataaaagtcattgattgataaagatctagtctctaccttcaggaattcagttataatgatctgcatacacttaactccaccagactataagctttctgagggctggatggctgttccatctgaaatgcttccccttgccctctgccccgaccaaggatgaacactgactgtggtgggaaaaccagatgaggcccatgctgctggctggctactcagtgacttccatctttgcttccaggagcctgaattttgcctgagactctcccagcctggggaagtgaatcaggattgctctaagccaattagaaaaatgtcattttctcttgccagtgattcatcaagggatgcacatgtgatgctgatctgggcaatgagataaaagggagtctgaggctggtcgcagtggctcacatctgtagtcctagcactttgggaggccgaggcgggtggatcacaaggcaggaaatcgagaccatcctggctaacacagtgaaaccccatctctactaataatacaaaaaattagctggggtggtggcacgcacctgtagtcccagctactcaggaggctgaggcaggagaatagcttgaacccgggaggtggaggttgcagtgagctgagattgcactgctgcactccagcctgggcgacagagcaacactccgtctcaaaaaaaaaaaaaaaaaaaaaaaagagtctgctgagtgtttatgggaaaggtttccctccccataacagagaggtactgggtcaagtagccattcttgctctttttctgctttgggtagtgctgggttaaggatatgatacctggaggtgtggcagtcattttgcaaccatgaggcaataaacacaagtatgaaaagccaacatgctgagtaggatgggaggggaaaaaatgaaatagatattgctgagtcattgaatcaactgctgacttattagcttattaataaacaataaaggcaaggtgtggtggctcacagctgtaatcccagctctttgggaggccgaggtggacggatcacttgaagtcaggagtttgagaccaacctggccaacatggtgaaaccccatctctactaaaaatacaaacagtagctgggcgtggtggcatgcgcctgtaatcccagctactcaggaggctgaggcaggagaattgcttgaatccagtgagcccagatcactgggctgctgtggtccatcctgggcaatacggcgagactctgtctcaaaacaaacagtaaatgccatggtgctttaagccaacatttagatgttttcacttgcttgcagctgaatatttcctgagtggtttatcggataagtgtagctgtggcaaattttattttccaaaaatggccccaataatatttctggttccccaagctcttccagacccttgccactgccctatgaggaggtggagtctgcatcccttctccttgaaactgggtgggcctttgtggcccccctccacagtggtaatgacattaagtatcttccactaaaaggcactgcagcatcccacttggctctccctcgggaacatgctttagaacccaggctttattttgtgaggaagctcaagaaaaatggagacgcccctagccttcagacccaagtgagcttccagccaacagctagcaccaacctgtcagctgtgtgaaatgccttttggacagggctgattgatcctgattgacaccataaacagagatgagccttcctgctgagccatgctcaaattgtagatttctgagaagaaaaaaagactgttgttctatgcctataaactttggggtggtttcttacacagcagtcaatacctggaaatcccttcctgcagtgcttcctataaatgccaggactgataaaaacagtactgaaataatttgaaggagggacagatgagagggtcaggggagggacaagggaacagagaagtcttctgggaagaggtgtctttttttgtaaaatagctttattgagatataactcacatattgaaagtgtacaattcaatgccttttagtatattcagagttgtataaccattactacaaccaattttagaacattttcatcaccccaaaatgaaatctcacaccttttaatcatcccctccaattcacctatgctcccttccaccagggccttagacaaccacaaatccaccacaggatttgcctattctgaacatctccaaacctgccaaagctatgccattaaaaggcactacagcaaagagcatcatgcaacttgcatcacactgggggcctggcacagaagtggcggtggtggcaccaggcagggcctgatccacggggtccagggtgaccatgtgggtcatgcaaatggcattacacaaatatgccatgcttggctaagttttttgtagaaaaggggtttcaccatattgcccaggctggtctcgaactcctgttctgccttggcctccaaaagtgctgggattacaggtgcaagccatcatacccagtcccttgaatactgttatgcaattgttccccattttctgccaggtgttggtttgaggatctattaggatactaaaatgtgagtatactcatgtactatagttgaccctgcagaacctatggaaacgaaaagtcagcccaccctatacacaggtttcacatcccatactgtattttccaaccatgtttcattgtggatgtggaaccctctgatagagagggctgactgtatttattgaaaacaaaacaaaacaaaacaagggttgtattggtggacccatgcagctcaaacccttgttgttcccaggtcaactgtatatccagagcttataggaaaatacctctcccagtaaccctgctcaccatttctctcttaagctattattatgattagccacggtttgctatttaaatttaaatttaaataaaaatgtggcctttcagttatgctagccacatttaaagtgctcaatagccatatgtggctaatggttactatttcggacagcacatatttagaacattcccatcatttcagaaattttcattgggaacactctgcggaaaaagggggccatcataatgtgagtccatcttctggaaaaatcctgggaaggggacaaaggaggtctgtttggcattgtgtaatggtaatttggtatttaattttcaaaaatgtttacccaattcctattcatcagccaggtgtggtggctcttgcctgtaatcccagcactctgggaggccgaggtgggaggactgctgcagcccaggagtttgagaccagcctgggtaataatagggagatcctgtttctacaaaacaccaaaaacaaaacaacaactttgatgttgtggagtcaggacagtcctgggttaaaacctttgctctccttagctgtgtaaaccgtgggtctcagctttcttatctgttaacggtaggtacttcttcctagggctgttttgaggattaagtgaaagtccaagattgtgtctggcacacagtagcttctcagcaaatgttttcctcctatgtcagggaatggctcctttatcccgttttgggcccatgggtggccctgaagggtgggtgctcaggtgttaagttctgtagatggcatatccttgggaaaagcaaggcaattaaaaacagtgagaggttgctctggttaagttttctcctataactttccccatgggtcaattgggtagaatctgccattttcctaatacttactgatggtagtggcattcggaagcacaatagctgaagccggagctctgagtggagagaaaggtctgtttctcaggcccaaaaagaggttacacacccatggctgtccagtttggtggtgcaggccctgaaatcagaccaaactggatttaaatccccaaacctatactctaagctatgtgaccttgggctagatacttcacctctctggccttatgaagtaggaataataataataccgtctaggttgttaggagtattaaatgaggtaaagcactgaaaacgtttagggactgtgttaaatcattaaataaataaaaacggggatgaccttatcggcttgacacaggggattaaatgagataatatatgaagacaagtacacggcaaatgcttaattaatgttgcttatttttatgtctgcaaactgacttaaaggggaggcctttaagaaagacagtggggcaatttgcgcgttgatgcattgtaggagaaaatgtgcagggggcccgttgggaccagagttcaaccaggtaagcggcagaaaaccacaaatacctccaggcgttcctggggcagcgccgcctccccaaaatcacgcaaaacttggtttgctaagaattgtcagctcttctaaaggaggcgcttcacgcatctcagtctgtgaaatgggacccaggacccaggtagaggtgcgttctcggcctggggaccgagtattttgtgcgctccggtaacgcaggaagacagcgccactgacactctagagaccagcgggcaccgcctggaggcgccttcaccacttggcggttccgggtccgcgccccaccgcgccacaagactcacgcccgaaccacgtgatcagggccgtggctccgccccgctcccgcgccgcgcgccgcttccggtaggggcggaaagcggaagtgtgggagggtctgcggggcgggctcaggaggtccgcgggaggatggagcagtgagcgggtctgggcggctgctggcagcgccatggagacggtacagctgaggaacccgccgcgccggtgaggggccactggctaagaggacgggcatggggtcaggggaagaaaaggcgggaactggttgaggggatacacctgtgtgggagtccccggagctaagcgacccagccgatggggcacctgctgagtgaggggggggacgtctggtgggtgagggtccggctgaggggagcatctgctaaggaggttagacttgggaccggttagagggagcactcgctgtggtgagactgtgctgaggaacgtggggacaagttagggagagtacctgctgaggccgggccactcgggggaacgctatccaagcagggactcacggaggtgggggcgaatgctgaagcagggtgagaatctgtgagggatctctttaagggggtggatcgagaactggccaagaggaaggccgggtggactttctaagggtctgaagtcccacttgaggggtgcggtggggggatctgtggaggggaaaagctttgcgcctaaggctgaaagcatgcgaggaaaggttgagggtctagcaagggaggggatggtggagggtagcatttcagaggatgctgttggtggtgtccccactgtaggatggcatcttttattactgatgttcagtgtcttcctaatggtcttcacatcctcctcagctcttcagaacctgacattgggaggtaggtaaggaaataagaggatattttcgagatggggagactgaggtccagagtagttgggaagtgtttccttctttactccgggtcactgaaccctgccagtctgtgcccttttcaggcctcagttgttttgtgaatatcagcaccaaatcctagtggtacctggaattgctttagttcaagatcaggatggtggctgatcctagaaaatctcaactcctggatttcccttgtggacatcccgggtcttttgccactctaccacatctggagaaaagtagggactagagaccgaaggagtcatgcttctctgaggttcagtgtggttacttctatttcacagagacgtctgacttcctgcagcagaatgagctctaaagaaggaagtgttcagggtgtggaagtgcagggcaaccaagaggtgaagagaagggattgactgcctgggcagcactcttaggggttgtttgagcttggggatgtttgaggtgcacaaacattgcagaaggcaaataggtggttgggatgggctttggattcaccctagcgtagtgtgctgagactgtaatagtaatgattattacactcatattgcacttaccgggtgccaggcactgttctaagtgctttccatgtgtcctgctgaagcatatgaaattgctgatatttgaccatttttgaaccataaaaacctcatttgaactcatttgaacctcacaacaatcctgtgtggtagatatccctatatgtctgttttacagatgataaaactgagatacagagggtagtgatttgctgggagaagtcatagcaagtaagagacagagctaggattttaatgtctatggggtctggtccaaagtccatgttctttttttttttttgagacggagtctcactctgtcgcccagtctgaagtgcagtggcgcaatctcggctcactgctacttccgccttctgggttcaagcgattctcctgcctcagcctcctgtgtaactgggaccacaggtgcgtgccaccacgcctggctaattttttgtagttttagtagagacggggtttcaccgtgttagccaggatggtctctatctcctgacctcgtgatccgcccaccttggcttctcaaagtggtgggattacaggcgtgagccaccgggcccggccatgctcttaactgcctcactctgatgcctctctaaaagtacccctgtttcacaggtctctgtgtatgttagcagatatttactatagtaccatagtgatccaattatgaatgcacactagttatgtttctttctgaactatgttcgttcgttcttcttggtttctttctccgaggccttggtttaattgaaaagaggattaggaatctgagttttgtttccccctttgccttgtcttacataatcttgagcaaaggactaaagtttcttggcatgctcattcctgtaccttttggattttaaaaaatgtattaaaagcacaagagaagagcattgcaggactgggttctgaagtggctggtgattcccagctcattgtaactagtagattgcctaatttgaagcagatcaattttattatcacgtgtatcagtttatcaggacaagacaaagtgtcatggagtgggtggtttaagcaacgtaaatttattctctcactgttctgaaggctagagatctgaaatcaaggcattgtcagagttgtttcttttgacgcctttgcttgactcgtagatggccatctccctgtgtctccatgttcttccttctgtacctgtcagtgtcctaatctcctcttataaggacaccagtcatactggattagggcatgcccatatgacctcattttatcttaattacctctttaaaggccttgtctccaaatacagtcacattcttaggtggtgggtattaggacttcagcatatgaattggggtaagctggggacacagttttattatgtaagattttgtccatttatcatgtatagttgttgtaatccatatcaaattctgtgtggaaaaagaaatagttacacataaaatgaactttatgggagttctgaaatgggagaaagctttgagaattagccagacctgtaagtgactacttcatagacaccattacttgtgtttggaaagatacaggtgtcttttcagaaattcagatggcatgtgtttccaataaccccagtgcaggaaatgccctttgtgttcgtgagtttgacatttgtgtgtgtgtgtgattaagtgatgacagattggtgtctcatataggagttaataattttaaaaaatgagttgccattagattaatgttatagtggaaggcgtagagtgcattcctgggatgctggccatccacatggccatctgacttaggagaggagcatccaccagtatttggtccatggatgctctgttgatcaggcttgttcatttatgagcaagtgctgaaaccgtctggaacctggggaagtcccagataagagaactgtattatcagagtcaggctgttttggtaatagtgttttttctgtgaagagtcatggtataaaatattattatgaatcacttatcaaaatatttttatagaaatgttgataattcagtaatacttcttaggtgaaattctgttttattgtgataattcaaagattgctgatgaaattcgtgattcccatcattacatttgtgaatccatttcacaaatatattttgaccacctcttggttatcaggcaccagagatgtaatagcgccttaagttcaagttgtttttaatagccccggatcaaaaacaaacaaaaaagcacttagattgtttcaaagatgtattcgagccgtcatatgctaaatgacgagttaatgggtgcagcacaccagcatggcacatgtatacatatgtaactaacctgcacattgtgcacatgtaccctaaaacttaaagtataataataattaaaaaaaaagaaaaaaaaagtttgtcaaagtattatcagaggtttgcagctgtctatctcaaggcagtggcaatttcctttgttatgctgtggtccctgaagtagttgaaatagtgacttttgcattttgtaaaccacagagagtcaacacttcaaagaaacatacttgatcttcctttgtataagctgtttatacaactttgattatacttgagaagtgaggtattgtccaatgtttatacaattacaattcaggactttaccaaaaaaaccctggcatatgagatgttcgttctgacttctgagtttatagaagtttcagttctgaagtttaagaggagtttcacttcatcccttttcattttgaaggtaggagtttttatgatgtcattggtatttaatttttaggaccttttgattttcaaaggtcactgtgatcattttgttctgttgatatcaagttaaggcagttttgacttggagcagttctccatttctctagtttatagtccttgatattcataaactataagattgtccttctgagatcagtgtttattggtagatacacttgatgtggtcagggtttttgttggtttgttttattttttgtcttctaattttaatctgttttatttaggaaggtacacatttgtgtgtgtgtgtgtgtgtgtgtatgtgtgtgtatttaagtcttttgttgtaataattgatattatccagctagtctaaacctttttttttctacaaagaggtctccagtgtgactacttccatatttcaccgtttcctcagctctctattctttgttgttctttgtagtttcaggaagccattgtgtagactacacacacacacacacacacacacacacacacacacacacacatattccttggcaagttccttctttaagctcattagtaattttcagagatctcagagttttaaaaaaatgttaatttataacctcccatgtttgttatgattgtctagcatagtcagaaatctgaattatctggaaattgtgagcagccaagtacctttgatttttgggactagtcaaaggtatgtatctactcataggaaggtctttgtgagaatatctgaaactcacagctgcctagtgatttttcacttttgatcatatctaaatgtacactttccactttctgtttctgtgatacctacagaatttatgtgttttgacaaacttacaaaaaacttgctaatggaagagcaaaggtttcccgtgtcttccttagtctgcagtccaattcatagttatgtttcaattcatagttaccttacattaaacaccttttctgaagagataattacatcattttaattcatgaaatctcaagatttaaatagattttgaaggatacatcgaatgcttgaatctacagcatttcagccacatgactttttttttttttttttttttttttgagacagtctctctctgtcacccaagcttgagcgtagtggcgcaatttcggttcactgcaaactctgcctcctgggttcacgccattcttatgcttcagcgtcctgagtagctgggattacaggcatgcgttaccacgcccagctaatttttttgtatttttagtggagacggggtttcaccatgttagccaggatggtctcgatctcctgatctcgtgatctgcctgtatcggcctcccaagaaaccttgtttcttaaaacagtcttaactagtgaagtctgtatagagaagttcctgagatgctaattataaaaaaaagatatattttatgttctagttcctagcaaataaaatgtattttgtgtttatatttctttattcacaggcagctgaaaaagttggatgaagatagtttaaccaaacaaccagaagaagtatttgatgtcttagagaaacttggagaagggtgagtgtaaagaaactataggtaggtcattgggtcccagtctttttcctgccccagaagaagcagaaggatatgaacctttcagcattgttctaggtggggtggaaggtaaatttacagcttgtgatgtccttcttcgctttactccaatccctattatagacagatttagtgattcctggtctttttaacacgaagaatatctattgttttctcttttgtaggatctgtatgattttatctacttaacagatagcactaattagattaaaattctataagaaactttttaatttgctgttcataatttctgattggtatgcaataactgtttcaatgaaaatcaatgtaatttagtattttaatatttgcacctttgtgaaatatagtaaataaattaagcactatcaccaccttcacagctacttaggagatccacaatcctgggttgggagccagtggatttcctgaaacacagatttgttaatgcgtttataaaatactgatgaaatgatattagtaatgtgcagtgaccatcattgactttcatgatacaattaagtttacataatttttatacttttatatatcattttaattcaatcctgtgtatttattccttcttctgtaatgaccaggaaattaaaatgttaatgacaccatttcttaagtttttcttgttaatttttgaataggcgatacaatcatatgattcaaaatttaaaaaaatattaagacgcatacaataaaaaaaaaaaaaaactgcctcctacctctctctgtctcttagccacccagaatcaccaagggtagcggcttcttgtgtgtctttcagagacaggctatgtgtgtgcgagcgcacactcgtgtttgtgtgtgtgtgtgtctgtatttttaatcccttgggagtatttctggatcaagggaagacctgacatactaacttgtaaaaacaactactgactgatgactatatgctctttaaaataatttcctttatgtcattagattattttttgggtttagtattttttatgttaggagacagatttacaacgttaaacccaatcctggattacatgaaatggtttttttatgatttacctccttgtaaaaaacatgagtcatcgtctttttgtaagttggaaaaatactctttggaatccagcaagaaatcaagcagagaagggaagtaaaaatgacacaccagctgtgctgtgaaaagacaagtccaagatgaatctgaagactgccagttgactggcatcattaaaggtatggggaaatgacagtccctctacatctgttgcctgccattttcagctttagcttgccatccttgctattttccctaaggcagcaaggctgtgacctttaatctaacaatgctcataagttatacttagaataagttcaagactgataggcataattgactatgtaacttatttctctcatttctaatacagtttgctcttactactacaatgtgaggctgacctgggttaaaatccttgctctactgtttactggtcataatagacaagtgggcttaagcaaattgcttactattttggaggctcacaatcctcatctgtaaagttgggataataatatatcaattcatagagttgtgttattacctgaggtaattggggtaaagtatagtgcttatcacaataataaatgttcagtaagtggcaactattgctattctattttaaatgtatcaactgaagcattttcaagacctcatcatgtcaagtcttaaagtatttttaggtgttgttataggtagctctgagctgattgggtttgtggaatgtcaaaggaagactatagacagagaatatatcagaaatataatgtaaacaaaaaataagctaattatgattttttaaattgtattttatttatttgtttgtttatttatttttgtagagacgaggtctcactgtgttgcccaggctggtcttgaactcttggccttaagtgatcctcctgcctcagcctcccaaagtgctaggattagagacgtgaaccactgcacctggacaaattgcgttttagatctatggatgtcttctgcaaggaatgtggaaatttccctatgaagatatcaccagggagaaaacaaagcttcagatctttcttcccatactatcaccttattgttcttctaaataataccagatttctggtatttcttggatttctgttattctgactgaatgaacctaagcaagcctcatttaactaggaatattttgaaggaagaccttcactgcacttcttttccaaacatgtgacacaatgctattctttttttttgagattaagtcttgctctgtcaccaggctggagtgcaatgtcacaatctcggctcactgcaacctccgcctcccaggttcaagcgattcccctgcctcagcctcctgagtagctgggactataggcacacaccaccacgcccgacttattttttgtattttagtagagatggggtttcaccatattggccaggatggtcttgatctcgtgatcttgtgatctgcctgcctcagcctcccaaattgctggaattacagatgtgagccaccacgcctggccaatgctattcttaaattgttcgggaggatgaatggtttgtgaactctcactgacttgtatcttgtgaaatgagctatggctaaaaaaactgttggattctggaggctgcaatcattctgtgttatgaggatcatatggatctgtggcagagtagagccaaagctccagaccaggatgagtggagagcacttgggaagtgttttcaagtggagcctagcaccttttttcttctacttaaagttgtacacattgactcatttgaatttttatcatagaatgataacaaaagcatcttgcccatggtttcataaaaaatgagtgctattgttaagacttgtatctgattaatttggcctcagatactgtggtatttccatttttctacatagatccttgccttgcatggcttatgtaaaacacctacttctccattctctgctgtcagttgtaattcattgaatcatctcattttgttgtagggaatcaagttttaagggacttgcttgtgagtatgattgctgaaatcttctaaccaccccctatccctgccttcagattactgtagatgcagtatatggaatcaggaatcttaacttcatgtgagctattggagttttccttgctatcaggatgcatagggaggtatgaagagtgttctggtcaagattgctgagtgagtgtatgaagagaactttctaatatataagaataatgagtgaaaattattttaaatataaggatatatagacagctatggacaagggataggaaagaaatctaaataatcagcggagactaaagcatgccttatccttgtcaggagattgcatttgagcttcctgcatgaagttgggggctggaactcggctctccatctgtgaactaaagctgaaataaatttgcctgaccacaaccagaaagtgtcatttgcctgtggcctagggaaaaaatggatatactggttcgataataggaactgagcttggattgtatttaagtatggtatcttgaagggcaaaaaccccaaactctgaatataagacctggtttaagttgtatatcccagactactgtactgagaaaaccatgaaatcatcgacagtgagtgtggtatagaggaaaatcattcaagagaaaatgaaatccatgcaaggaaatctactgccatgagataatcagcagaatgggagaattcacactgaaggaaaaagaaataatgaagcaatctcaaaaacaatttaatataattacaattttcaaaaagatcaaggaggagataacatttttaaaaggacatcagattattgacatgattattaacatatttgcccaaaggcagataaaaagttgggaatcttgacaatgaaaactacaacaattgaagttttaaaagcccaataaattggataaacagtaaactagacaaactgaaaggagaatttgtgaattgaaagatagaaatgagactgatcacaacatgcagaaatacagtgttggaaaccaggaagacaacatagattgaggaggtctaatacagttttggtaggaattctaaaagaagatcctagaagtggtagaggaaataatcacataataatcctgagagtttttcattcttgaggaaagacacgagccctcagattgaagaagtttatgaagtgccagatcaactcctagttacattacagtagaatagtagactgttaaggacaaaggaaaccttaaaaactatggggagattacccatggaaaatgataatctgataaaagctgacttctcagccacagtcgatgttggaacactgcaacaacagtgctgagggaaagctgttgtcaatccggtatccaaccaaactatcattctagagtggaggtgaaataaagacagtttcagacatacaggagctaatttatcaagaatgcctttggatggaagtaacaatacccaacaaacagtggctaaccaataaagacattaagaactaaataatacatctgggggtgtgagattcgagaagccgttaattggcttgacaatggtttgacatctgggtaattctcgtagtctcaaatggctgcattagtttcaagcatcatccctcacatggcagtaaccaaagaaagaagggaagtggcaggtggaaatgggccttcttgtgtgcttgtctcctaccagggaagaaagtctttcccagaaacctttcagcagaattatcttcaaatttcagtggccagaactgggcgacatgtttgccactagttcagtcactggcagaagggaataggaattctgtgagtggcttggactaccatggtatatctcctgggacgaagcacatcaccactgtaacaaattaggaagttattttagcaaggaagaagggacacatgctcaacagttgcctctctctggcaaaaagtatttggtgtaatatttaaggatgattatgctagttttgcaagtatgacagcttctaatggaatggaaatatttttatgtgctctgcatagacttaaaaagttttatgttactttcacattgaaacagttcatgagcatctatttggcagttagagtattgtactttgacatagtaggtggcactgctattttgattttttttttcaccaagacagtgtgaagatacagatgtgttgggaaatatgaaagacagtttactcagtattatttcactgacagctgcccaggattccaatgaaaatgttatctgtataaagtgatgatggtatctcatttgaccatcacaaatgagataccatcacatcttgtaaggtagtttgtattattgtcattttacagatgagaaaattcaggtacaacaaggttaataaggtgtaaatgatagctaaatgtagtgttggtaggactcaaatccagcttctttactttcaaaatctagtggatctgtagcctccaaattgactagatacacaaactttattttgatattaagctgttaagggaagatggagtaggaagcaaagagtgtgtgtgctgtgtttacctgatactaatattaaacaggcttagattttaattagtttccataatattttaagtattattgtaagtaagaggagcaaggacagaaagatcttgtggtactagagtgaatacaataaaacaaagactgccacttccatattgtaccccagtatagatggggagacaacgtaagctttgttttcagacacacccgggttcaaatcctggactgataacacaactggtttcaaatcctggactgataacttatgtgaccttgggcaaatcataaacccctttgaacctttttacatttacctgtaaaatagggatagtcatctcatcttcattttttgtaggaatgaattgagatggtgtacagtctctagcagatagcaggcatgcagtgcatggcagctactatattaccatctcataagaatacattcattacagttttgaatgtgaagctttcaagatgccattttgttgtagttctcttgacagttttttccccaaaagtattttagctatcttagttttgcaagtgtatatgtattaggcacttagggatatatgttagaactatcagttgcttgtgttttaccacttcttatatcttggcttgctttgactttataaatgttcttcttctcccaaatgtataggtcctatggcagcgtatacaaagctattcataaagagaccggccagattgttgctattaagcaagttcctgtggaatcagacctccaggagataatcaaagaaatctctataatgcagcaatgtgacaggtaaaggcatgtgggcttcctttggggagaatgtggttttgaattagctatgattgtgtagagtttgatacctagagacacatttacttagatattttgcagaagggagaattcgatggaatcactgtgcattttcttttcagaaaaaaatatgatgataatggttgtttttgtagctaaacctccgtaatttttatgcatggtgttttgtttttttttttcaatttttctttttttttttttctgagacaaagtctcgctctgtcgcccaggctggggtgcagtggtgcaatctcggctcattgcaacctccacctcccaggttcaagtgattcttgtgcctcagcctcccgagtagctgggactacaggcatgtgccactacgcccagctaatatttttgtatttttagtagagatggaatttcaccatattcgtcaggctgatctcaaattcctgaccataaatgatctgcctgcctcggccaagtcccaaagtactgggattacaggagtgagccaccatacctggcttttttcttttcttcagtgagcccttttagaaactaggaagaagaggcagaaggtggtgcttgcttttttttgtgtgtgtgataatgatcttttttacttcctattgagaaaacatttctgcagagatagccaagaacagataattcaaatgttttttagttctagaaaccttagaatatcaggtaaatctataaaaaaagagtagttatgtatatactactgtttgttccttcacattaaaaaaaattattctagctgagagtacctacgtatttatttttgaggaactaagatttgtcaaatgttgtaagcaggaagtcagaccaaaagacaaccacagaaaaccacgtggtttgctctgaaattccatgacaacatgggttggtcactgatagagcaggcttccccagcactatttagattagagacaaacacaaagttaggggcaatgccagctctagggagctgaagatgggtgagaaattctctcagttgaagctgcattcattcttctgaaggctttttggtcagcagatcaacttagtacctgctgtttgcaaaacttctacattagggtttaggtggggctacctaccaaaaaattagtccagaagcctttcagtctcacagacttgggaatgtagtcctttcttttttctctcccttctttttttttcccttctatttttgtgattactgtctactagataaaatccccatttttcttgattggattgaccagatgaaggtggcagttttccatttgctcctttttcagatacattttggaagttctttccatttggcaaattgggactttgtcactttcgatagactgtgcgggagctgtgttccaaacagagtatggaaatgtctttaattaaagaagagatattttcaagcgtctactctgtgctaagcactgtaaggaatacagtgaaatacagagcagagtccttgtgctttgggagtttatagactaattggacaggctaagtatatatatatgtagaggagaatctagccaacagtgcaagtctatagagaacatattccagtagtaaatacttgatagtaatggcctacagtatttaactcctgtcagtactgtattacagggagagtaaatgtgttgatatttaccttagacacttttttcattaatatttaatgtgtgtgtgtgttttgctgtccttgtcactggcatgtttcctaaggtttgaagaggaaattgtaagagttctgagttaatgaagccaatttggttttaacatcagttgttaggaaacttcatttggccatgataacaatctagccagttaaagctggcagctctcagagggcacattattttattttaataggatatttgatttttctctgaatttcttgtttggtatctctcttccagcttgagacctaaaattccaggtttgatcctgaacattttttctttataatagattgtagtatgtgtatgtttttattacaaagtacatatgacttcttagaaaaattcaaatgaaaagaaaagaaaatcacttttccctttggagaaatcatcattttttcttttttttgagacggagtctcctcactctgttgcccaggctggagtgcagtggcgcgatctcgactcactgcaagctccggctcctgggttcatgccattctcctgcctcagcctcctgagtagttgggactacagggcctgccaccacgccaggctaatttttttgtatttttagtagagacggggtttcaccatgttagccaggatggtctcgatctcctgacctcgggatccgcccacctcggcctcccaaagtgctgggattacagatgtgagccactgcgcctggctgaaatcatcattcttaaacactgcttgatacacatattcttccaaatcactttggagttttacagtaattcctgttttgtagcctgcttttttgtttgtttgtttgtgtaaacacagtatcttctcatgttatcacatagtctataacatttttcatggattcatgatattttattatacggctatagcattctttgttttttttgagatggagtcttgctctgtcgcccaggctggagtgcagtggcgcgatttcggctcgctgcaacctctacctcctgggttcaaacaattttcctgcctcagcctcccgagtagcagggactacaggtgcacactgccacggctggctaattttttgtattttagtagagacagggtttcaccatcttgtccaggctggtcacgaactcctgagctcaggcaatccgcccgcatcggcctcccaaagtgttgggattacaggtgtgagccactgcacctggccctgtatcattatttcttaaataaactccctaatgttggatggacatttagatgatatctaaatttccacttttgtcaatagtgctatgatggtaactgttactttttgaacatttataattcttttttgaggataaattgtagacatagaaatgctggttaaagaactcaccaagttttttatacttttgtgatttattaccctccagaaaagctataccattttgcattcttatcaggaggttgtccattttatccttaactatgaataattgatctttccagatgaggaattaatttgtatatacttgctagcatgaattaagagatatttgaaggccattttattaatttgtattgtctctctctctctagccctcatgtagtcaaatattatggcagttattttaagaacacagacttatggatcgttatggagtactgtggggctggttctgtatctgatatcattcgattacgaaataaaacggtaggtttaccttctagaacatgcaactgagctagtttcttatgccatcttcttttctctgcctctttttcagggcattctcctactagagagacgactgtcagatttccccttttccatggttattttccatctttattcttttatgtctcctaagtgtgacagctttttttttttttttttttcaagagaccagagtcccctgtcacccaggctggagtgtagtggcacagtcatagctcactacagtcatagctctacctcctgggcttcagtgatcctctcacttcaggctcctgagtagctgggactacaggcgtgtaccaccatgcccagctaatgttttgttttgttttttaattttttttttttgtggagatggtgtctcactgtgttgcccaggctggtttcgaactcctggcctcaagcaattttcccacctcggcctcccaaagtgctgggattacaagtatgacccccccatgcctggcaatgtggcagttttgacaccaatttagtccagtgatttttagcatgctttggttatttcttactgggaagaaaatgactgttagatcttagttatagaatgaattttaaatgtttaaatttggatttggatttgggtttctgcttctacctagcgtgttcacaaattaaattcctgtatttcctgttaatcagagaataatccccttatgaaagattatttgctgatactgtggttgcagtataagacctaggagtcatgggttttagttctggttcagttacttaatgtctttatgtattcgttcagtaaatatttcttgaacactgttttaggcctgaaggatctaatagtaaataaaacagatgacaactctgctgtcatggtagtgtacttcggaatagggcaacaaaagcaaattaatagtaactattaatagaaaagatataataatgatatatactatgaggaaaatgaatgaggatgaagtgatggtaaagttgtggagactggtgggctattttagagtagatagttgaggaaggtcactcagaagtggtgacgtttacaggaagactcaaatgacgaaaaggagctaagagtcctgaaggaacattgtaggtgggcagtaaccagtgcaaagaccttgaggctggaatgagtttggcatgtctgagtgatagaagggctaccatgactagaagggaataggcaaaggagaagctgtaggagatgaggtttgacaggtgggcagggctagattgtattggatattgcaggtcatgggaatgagtttgaattttatcccaggtattataggaaaccattgctggattctaagcaagtgagcgagccatctgatgtatgttttagaaagataactctggggctgggtgtggtacctcatgcctgtaatcccagcacttggggaggctgaggcggaggattgcttcagtccaggagttcgaggccagcctgggcaacatagcgagacctcgtctctacaaaagaaaaaagaaaaacaaaattagtcaagtgtggtgtcatgcgcctgtagtcccagctaacttttggggtgtgatgggggttgaagtgggaggattgcttgagcccaggaggttaaggctgctgtaagctgtgattgcgccactgcactgcagcctgggcagcagagcaagactctgtttcaaaaaataaaaaagataactctgacttctgggtagattgtgggtggataagtggagaagtagagaaaatcttagcctgtggtttttttgtcttaataagaaaaataagaataataatatctgtattccatatttgcaaagttgggaaaattaatttaaatatgtaaaagtactttgtaaattgtgaggtgctacacaaattataaggtgagggtgttttaaaactgagttataacttttggattattcatatactatcttcttaatttacattattcagaattagtgtgtttgcttaatcgaatagcaagttctttaggaataatatcctaacataagatatatgtaaagaagttccaaaactggaataatttattgaattaaacattggatttcagggcttcttatatgcagcattaagtcaatttatttcaggtattttaaactagtccaaaattaattttgatggcacttttggtttttttttgccattgtaatagtaggttattatatttaagtaaattttaacttaattactaagtgctggttttttgttgttgtcgttgtttttttttttttttttttttttgagacagagtctccttgctctgttgcccaggctggagtgcagtggtgtgaactcggctcagtgcaagctccgcctcccaggttcatgccattttcctgccttagcctccctggtagctgtactccctagtacaggcgcccgccaccacgcctggctaatttgttatgtatttttagtagagacgtggtttcaccgtgttagccaggatggtctcgatttcctgacctcgcaatctgcctgcctcggcctcccaaagtgctgggattacaggcgtgagccaccgttcccggcctaagtgctgatttttaattactacacgttattttgccaaatgttataactctgccctgtccaccgtgatatccactagccgcatgtggttattaaggacttaaaatgtggctagtctgaactgagatatgctgtaaatataaattatacaccagagtttgaagaattattgccataaaaattgtaaacaaaaatctttgattttttcatattgatgacatggtggagtgataatattttggataaatatggttaagtaaagcagattatcaaaattaattctttctttttttttttcaaagatagagtcttgctctgttgcccaggctagagtgcagtggtgtgatcataggtcactgtatgttggaactgctgggctcaagtgatcctcctgcctcagcctcctgagtagctgggattacagcaccagccactgcgtctgcttgtttcctttttcaatgtggctactagaaaattaaaaattatatttgtggttcccattatatttctattaggcagtgctacttcaactgattaacttaactggttagaataaagaggtggtaagtcaagtcatgagctttgttctcttccactatagaaggtaccccagactctagcctactaccttgccagtagtgtttgcctggactttagtgaaagctttatcatttctctctgacttttggcataaatgacttaacttgtctgtgccctcagcttcattatgtataaaatgatgatgataataatagttcctctacctcatttagttgttataaggatgaaatgagattacatagtgcttagcatggattaaacacttagtaacggttagcctttatttatttatttatttatttttgagacagagtctggctgtgtcactcaggctggagtgcacacaatctcagctcactgcaatctccgcctcccgggttcaagtgattctcctgcttcagcctcctgagtagctggattacaggtgcctgccaccacacccagctaatttttgtatttttagtagagacagggttttgccatgttggccaggctggtcttgaactcctggcctcaagtgatctgtccgcctcagcctcccaaagtgctgagattacaggcatgtgccactgtgcttgactttttttcatattattagcatagtacctggtgcttattaaatattgattgataatatcaaaggtgttaaattatgacatattaattgattttcatgacactcttaaaagttatattcctattttatagattgggaaacaggctaagagaataagagaaggtcagtaacttgcttaagtcacatgaaagtagagccaagagtaaaagctacgtcttcctagtcccaaatcctacagtttttgcaccagagcacactccatttcacatctgagttgtttgtcagaaggggaactatgtaacagtttgttgatagattgagtttgtttaggactggtgttgggtctgcagaaagtctatattggccagatcagatattctatactagtttctagcattctcactttcaacagatatttttttcagtgcctactgtgtgccaggtggctttattggtattagggaaacaaaagtaaacaaatcagacatttttaggagcttgtgtttctaacagggatgatatcacatacatagataaataatgggtaatatgtcagatggtagtatactgcagtgacaaggtaatttaagggaatagagtatgagctagaaatggagtaagaaagccctctccattttctgaggaggtgatatttgggcagattacaaactgaggaagcatactggatagacatcaggatgaagagaataggcagttgaaaagtcccagaaaggggagtgtgcttagagtgtttgaggaacagcaaggaagcaagcccttgttgaaacagattgagcaaggtagaaagtggtaaaagatgaagttaaagaggtagctgagagccagatcatgtaaagccttggtaaggactgacttttattttaagtgggttaggaagacattggtaggttttgactctggcttacattttaattatagcttctgtgtggaaaatacattgtagagtgtcaagagcagaagcaaagaagccagtcgggagattatgagaatagtgcagtcaggacacgatggtgacttggaccatggtgattacagagggtgtatttggatatacagtgttttgaagatagagaaaagtcaaggatgacttcaaggtttttgaccagagcaactgaaagaataaagtttccttttactgagagagggaggactgtgggagaagtggagtaggttggaaggatcagagggagaggggtaaggtgatagacatagagtttgattttgacatgttatgcttatgatgctggctaggtattctagttggagatacataaatctgattgaggggagatctggtatggaaatatagccttgggagtggtcagtgtatctatggtataagcagtcaaatgctgttcacaggttgaataagatctgtttatattaaagaaaggtttggatctgattttttctcctttttctaatgcgctgatgtaaactgatagaatttgaacttcttattcttttttcagttaacagaagatgaaatagctacaatattacaatcaactcttaagggacttgaataccttcattttatgagaaaaatacaccgagatatcaaggcaggaaatattttgctaaatacagaaggacatgcaaaacttgcagattttggggtagcaggtcaacttacagtaagtaaaaatattacttgtattgataattttcatttctgtcctgagaagcagttccttttatttacctatttttaaaatataatacttgacttaattgtattagtaaaaaatcacagaatctgccaataggttacaaaagagctagttagtgggttattttagatcttttcctggggttcaggtcacatagcttaactttgttcaacttttataaagatgaaaagtaaagcaagaaatgatagattactctagtgcactacatcaacatatttataaaaggaagaaaaattaagaggaagaaaaattaagtccaaactgctttccttgactaagacataacatcatctcattcaacttccaggtagtacttggcagttactgtactgaaaacactctgttcgtttgagtccaggatacagtctcttgattcttctcctgcctaactagtgcatggaagtgaaaaaagaaaaaaaaaaacttgttttcaaaataggaagtctagaattatttgattctacataagtatatatgaaagtatatatagaaaaatagaaatagttttaggcaggtatactctaaaatttgcaaaaatattacatatcaagtggttttcttgggtggtagaatgaatatatatagtgtgtgtttagaactggtgttatgtacggttttttttttattattttttttttattataagtctgcctgggacatgttagggagcctcaggtattgtaacagcacagaaattgctttgatgtttaaaataaatcagaaccttattcagtatcatgatttgtgggctctccaaaaggttttgttgttaacacaaaagtaaacagtaccagacaatattacctaaaccacagtcttagtcaggaaaccaaattgaaaaaatacaccctctgatggtctataaaataatataatattggccgggtgcagtggcttatgcctgtaatcccagcgctttgggaggctaaggtgggaggatcacttgaggttaggagttcgagaccagcctggccaacatggtgaaaccccatctccactaaaaatacaaacattagccggacatggtagcgcacgcctgtaatctcagctacttgggaggctgaacctgggagattgcgccattgcactctgcactccagcctgggcaacagagtgagaccccatctcaaaaaaaaaatgtgtatgtatgtatgtgtgtgtgtatatatatgtgtgtgtgtatatatatatatatatatatatatatatatatatgtatccattccatttactaattttagtaattgattgattacccaataatgacttacagtgttcttattgctataatgcctgccttggcagaatttttctccccttttaatatgtacaattcagtgtttagtatattcacaaaattgtgcagctattgccaatgtctaattccagaacattttcatcatcctcaaaataaactgtaccctttagctgttagtccccattctcttcccagcccttgacaaccactaatctactttctgtcactatagatttgcatattctgaatatttcatataaatagaatcatacataatgtgcccttttgtttctggcttcttttgtttaacataatgtttttgagttcatccatgttgtaacatgcatcaattcttcattcctttttattgctcagtaatattccattgtggctgtaacacattttgtttacttattcattagttgaatatttagattgtttctgctttttggctgttaggaataatgctactgtgaaatttgtgtacaggtttttatgtgaaccgttgttttcatgtgatacacagagttgctggatcacatggtaactctgtgtttaattttttaaggaactgccaaactgttttccaaagtggctcaccattttgtgttccctgctgatgtatgagaattccaacttctctgcatcctcgccaacattttcttttttgtgtttttgattataaccatcctagtgagtatgaggcagtatctctttgtggtcttgatttgcattttactaatgactagtgatgtcgactgtcattttttctgcttattggacattcgggtatctttgggaaaatgtctatttaaatcttttgcccatttttaattgggttatttaccttgttattgttgaattaagagttctttatatattttagatataagtctcttatgtacatgatttgcaaatattttctctcattctgtgggttgtcttgaaggtgtcctttgaaatacaaaatttttaaattttggtcgtgtccagtttcttttttcttttgttgcttgtgcttctggtgtcacatctaagaaatcattagctaatgcagggtcatggagatttactcctatgatttctttgaagtgtttaatggttctagctcttatgtttagatctgtaatctgttttgagttagttttcatggtgtgagataggcatccaatttcattcttttatatgttgatatgtagttgttccaacatttgttgaaaagactgttttttctttgttgaaatgtatgagtttatttctatgccttcaattctattccattgacctatatgtctgtccttgcaccagttctgtgctgtcttgattactgtaagtttgaagtaatttttgaagttggttaagtgtgagtgttccaactttgtccttctatttcaagattgttttggctattctgggtcccttgtatttccacataaattttaggatcagcttgtcaatttctgcagaaaaggccgttgggattttggtagacattattttgaatcgtaaatcagcttgaaaatactgccattttggcaatattgtcttccgatctatgaatataagctgtctttccatttatttagattttctttaattcttttagcaatgttttataatttgcagtgtacaagttttgcatgtatttggttaaattcattcctaagtagtttgtactttttgatactattttaaatggatttgccttattttcagattgttcattgctagtgtaacatacaattgatttttgtatattatcttgtgtcctggcaccttgctggacttttttttttttaaattaactgtgaacatgtatgttgttttgttaaaaaaaatgagattttttttccttcactaaaataaactgaaactgtagtacaagatgatctgacttggctgtttggttgtgaaacctccagtactactaagtttaggcccctctccggtctcttgtctagaggctgtaggccttgttggcagctttctgggaagtggtggtggtggtggcagtggggattgttaacatgttaatgctcatttaatgttcctgattcacaacaccacccacactctctatagtctagagatcctcggtttcactccccagagagtacacctccagtctaatgccagggtggggcgagggaagcccactagttgcttgatgggagaggaaggtttagggtgcttagctgcttcttaactctttcaacccaggcttcctatttggatgtccgttttcacccctcttttctctgcctgatgccaccaatttctaagtcttttggaggggttggtgttaaaatcaggttgtttcctagttttcctggcgactgactgaggattccatctgatagtctgttcagttagttactattgggccatctgctctccagcttttaaaattctgtggctgtagttattttcccctttgtttttttattcttgtagatttattcttaaaaaacaatccttttagtatctttttgagtgagttttgagagatagtgaaagtaaaatgtatttgctcaagctgtcatctttacccaagactctgtaatattatttctggtggcaacatgggtatttcattgtatggatatagcatgatttatttaactctttccctacagttggatgttgggtgcccattaaggttgcttagagttttcccaccactataaacataaactctgtgattaacattcttgcaactaaatttttcagcatttccttgagtaaatccttaggataatttatttacattggaatctaggtcagaaaatatgtgaatgtatattggcaaagtgcttttgatgcatagtgctgaatttcttctagaagtgaacagtttcagtttccaacttcagtatataaatgtgctcttttcccctcatatttgctaatgctgaatgggcagcaacttgtatcttccctgctatttctcaaagcagttgacatatttttgcatttaattattggccatttataaaaattcgtttgtaaatgttcatttttgtgtcagttttcctaattgaatgttgtactttttttttttgtttttgggagacagggtcttgctctgtcacccagcctggagtgcagtggcacaatcacggctcactgcagcctcaaccaccaggcttaggtgatacccccacttttggcctcttgggtagctgggactacagacgcacaccaccacccccagctaatttttagtagtttttgtagagacatagtttcaccatgttgaccaggctggtctcaaactcctgagctcaagcaatctgccccccttggcgtgccaaagtgctgggattacaggtttgagccattgtgcctggctgagtgttgcatcttttaaataaatcttattaaaaaagataaactaaaaaaatttatgttaaaattgttactcctattttgtatatgctgaaatatcttctagtttactagttgtcttttaattttgattatggctttttaaaaaaatactacataagtttccaaattttatatagaaaaatccatctaccttttatcttatggtttctatctttgatgtcatgcttaaaaaatccttttctccttaacattatagaatggttaatctatgttttttttattttttattattttattttattttatttttttttgagacaaggtcttgccctggcacccaggctggagtacagtggcatgatcatggctcattgtggtgtcaaactcctgggctcaagcaatcctcttgcttcaggctcccaagtagctaggactacaggtgtgtgccacttcgcccagttaaaattttaacattttttatagagataggctctccctattttacccaggctggtccggaactcctgcctctgcctcccaaagtattgggattagaggtataagccagcacacctgctctgttgctcaggctggagtgcagtggcatgatcatagttcactgtaatcttgaacttctgggctcaagtgatcctcccaccttagcctcccaagtagctaggactacaggcatgtgccaccatgcctggctaatgtactgttttttttttgtttgttttttgttttttgtttttgagacagtctcgctctgtcacctaggctagaggacagtagcgcaatcttggctcactgtaaccttcacctcccaggttcaagtgattctcgtgcttcagcctcccgagtagctgggattacaggtacctgctaccacacccggctaattttttgtacttttagtagagacgggatttcgctatgtttcccaggctggtttcgaactcctgagctcaggcaatctgcccacctctgcctcccaaagtgctgggattataggcatgagccaccgtgcctgactgtctaatgtacttctttaaagtattcgttgggctttgttttttatgtttaaaatttcaacttatttgaacttattttggtgaaagtataaggtaggcatttaagtgtagagttctacaaatgactagattcccagtgcttttttttttcataatctattctttgcttgctgattttaaatgacattttaatcataaatcatatgtatatgtggtatatataacaggttattatatatacatatatatgatatatatgtacacacacacatacatatacacatatgccatagtgaacttctggactttatattttttattgctatgctattgtactaatataactttataatacaaatctaagtggggttagtgtacactcattgctcttattaattttcaaaaactttctagctatccaagtaaccatttctaattgaaataatccagtgaaaacaattttgactatcaccatttgaaaacacccttgcaaatttgaagtttcagagctaaggaaatgactaagcagtaagttagttcctgtgttagttttttacataggactgacaatgagattgatttaaatgacctgtcatttgcttctgactggcatagcctaaatcacaggcatttcagaaggaatatcagtgatgatgatcggaagtcctttttcgtatttagttctgtttaaaaattcttcttttgctgggcattgtggctcatgcctgtaatcccagcacttcgggaggccgaggcaggtggatcacctgaggtcaggagtttgagaccagcctggccaatgtggcgagaccttgtctctactaaaaatacaaaaattagtcgggcatgatggtgggcgcctgtaatccaagctacttgggagactcagtcaggagagtcgcttgaaccccaggggcggaggttgcagtgagccaagattgtgcctcttcactccagcctgggcagaagatcaaaactctttctcaaaaaaaaaaaaaaaatccttcttttgctaaagcataggaactgtagggaggttctctttcagtagggccatgccatcctgagaaagtatgcaagtggttatttgctgtaatgtgtactgtatccacatattcttctttagcccataaactaagatattttgtatattattttttatatatcaagtttaaaatttttttattgcacatgtatgctcatataaaccttcagaatgttacagatgtatacaggatagacagtaaaaatctttagtgattctgcctactagatataattaatggtttggtgtgtattactccagattttttgtgctatgatataacagtgtttcatattattggttattgttttattattgttatgatcatcattattatatatattttccttttacaaaaacagggctatattatatataattgtacaacttttttttgctttgtaatgtatgttgtgcatttttttcatgctaggaaaaggtatatatcttcttttttttttctttttaatatggtgtttcagtatatggttatttattatatttaacttactatcttttgatgatcatttgagttgtttccttttcctcctcatctcccccattacagacatttctacagtctttgtgcatatcgtttgagatacttgaacataagatagatttcaagaaatagatttggatcaaaggatatgaatatttaaaagttgaataaatattgccaacttatgtactaaaatgtaccaatttatactacagtaacattttatttcggtgcctgattttctatgctattatcagcattaattattaatttaaaattttttgtcagtcattttagtttttgttttaataattgattgagaatctttttgtgtttctttgtcatttgaatttcttctatgcctgcttgatcatgctcagagtatggtttttatatgtatttcaagtacaaggcatttttttattgttggaaaagcctctttttctcagtagtttttttttttttcttctttttttctctgtagacttcctctgtggacatctcagtagttttaagcttagtgtcagtctctctccctttctattttaggataccatggccaagcggaatacagtgataggaacaccattttggatggctccagaagtgattcaggaaattggatacaactgtgtagcagacatctggtccctgggaataactgccatagaaatggctgaaggaaagcccccttatgctgatatccatccaatgagggtaagaaagtggacagaaagccagtggggtggttagttactgatcatcattaaaaagtgaagttcaagccaggtgttgtggctcacacgtgtaatcccagcactttgggaggctgaggtggatggatcaccagaggtcaggagtttgagaccaacctggccaacatggtgaaaccttgtctctactaaaaatacaaaaattagctgggtgtggtggcgtgcgcctgtaatcccagctgcttgggagactgaggcatgagaatcacttgaaccccagaggcagaggttgcagtgagctgagatcgtgacactgtactctagcctgggagagagagtgagactccatctcaaaaaaaaaaaaaaaaaaaaaaaagttcaatggcttacttgtttaagttgcaaacaataaatgaattatgtgtaaatttgtaagtgtcgctatagatgatacacctctactgactctagttgtagtcattaattaatttaagtgtgttccacccctctccattccagaggttgtgtattgatagccctctggcaggacataggccatagaaatgcttagtttgatttgtgctactctctctctctgtctgtcactcactcattttgaatagtttagacaaccacattttaacatgtcaacattcactagagctgagtagtggttcagagtatgaactctctactttatcagtctccatgattccctgttgtgtcaccaagtattagctgccacttattacagtatttctctaatgtttttcttataatagtgttaagaagaaagcaaactgtatttttgaactcatgtcactgaaacccagccttgttcattttttatctttcttctgcctggcccctataggtgttttgaatttgtaagttttggtttgtagatccccatatcctcttcatctggaggctgtgtactctccaacccctgtctccttctagaatgttaagggcccatagaatgcatctccagtgaagctcttccagtgctcacaccctaagcagttcccaggcttaactgtcccagaacccttcatcacagcactgttgtaatacacccccccgccaaccctgccttcctcaggggctctgtggtcctctccatccttccttaccacagctcttcctcttctctgactaattaattctcctattaaaagacttacacaaattcatgttcccaaggtaagtcctccctcttttttgggagaaggagtgaggagatttactagttacaattttagatttaaagaatataatttaagctgcttatttgtatagtgttttacttttcaaaaaacatggcttttttaaaattggaaatttaataaataatagtcttatttttggacatagtagaatgtaactgcaacgtagtgggccaatttttaatttttccccctcacacatgcgttgatttagcttactttggaagttaatgaccccattgtgatttttgggacttctggttgatgaccttattgtgtagttgctgctgacatctgggggtggtaataacttttaagaggcagggaaacttgacaactatggggtcaaggttatctttaggatgtagatactcttaggtctcgcctttctactttgaaaggcaatgtactgtggttaccaaaataataataataaaaaagcttgattgatgttgtgaggtttagggaacaagacccatatatgagagagggaaaaggagagagggagatatatcaggttctttaaccatcagatgcttagacttttgttggaatttgggtgagcttctcagtgggtaagtgaaaaatcatttaccaagcttcaaatgtaattccacatgtattttttattggagcattacttttattttaccagatctttttgtttgtttgtttgttctaaccaggcaatcttcatgattcctacaaatcctcctcccacattccgaaaaccagagctatggtcagataactttacagattttgtgaaacagtgtcttgtaaagagccctgagcagagggccacagccactcagctcctgcaggtatgaatcaccctgtgatgccatctcgctccatttcatttacttgctgaccaaaagatgccatgaggtcacctacgtggagatagtaaagaagtataaggcaggctgggtgcagtggctcacgcctgtaatcgtagcactttgggaggctgaggcaggtatattgcttgagcccaggagtttgaggccagccagcatggtgaaaccatgtctctacaaaaagaatgcaaaaaattagccaggtgtggtggcgcatgcctgtagttccagctacctggaaggctgaggtgggaggtgggagaatctcttgatcccaggaggttgaggccgcagtgaggcatgattgtgctgctacattccagcctgagcaatagagtgagacgctatctcgaaaaacaaagtaaaagaagtttaagacattctctacctctagggaggtttgaatctatttgagtagaaaagaatgttaaatcattgaacaagacaataatgtaagaaaatacagggcagtatgggattagagaaagggaactgacatttagtgagtacctgctgtccgccacatactttgcatatgtgccatttaatcatcacatagaccctgtgaagggtgggtattatttcagttttatagataaaaaatggaaacttagggaggtttactcatttcgggtcactcagctggtaagtagcacagtcagtattagaacttgagccttttttattccaaagcaggggtaccatcaagtctacccgagtctgacaaagaattaagagcagtggtgggtactgttgtagttcagggtgggagaaggcctctttggactggagatgcaaaaagtgttttcctggaggaggtagcttctaggcctggtccttgaaggacaggtggcatgtggcaggcagtatgcttagtggttaggagcttggatcctggtcagattgcccaggtttgaatcctggctcccaatttactagctttgtgatcttgggcaagtaacttaatctctctgttcttttggttttgtgatctgtgaaatggggatacagtacctgcctcatgtgttgtgatgattaaatgatataatgtgtgttactttgaacaatgttcacatgtattgaagacagtatggtatgaacgtgataaatattagctattataattgggctaggccaaccgtttgcagtcatttcagacccagtgccccctttttataaccaatgtatatatttaaaaactctcattacttttctggaatgaaactcacatataataaaacctttttatgcccataatttaaaaagaatcaatattgtctatgatgtgatggagaaaaataaagataatttataatgaaataatatggctttcaacgtgcagttacttcagcctgacccagtttgcagacataatgaaatagatacctgtgcctggcatcatgaatgagtttagatttaagagctgtaagaaaatcagaaactagccaggtgcagtggctcatgcctgtaatcccagcactttgggaggctgaggcaggcggatcacttgaggtcgggagtttgagaccagcctggccaacatggtgaatccccatctctactaaaacaatacaaaaatgagctgggcgtggtggcgcatgcctgtaatcccagcaggaggctgaggcaggagaagcacttgaacccg[133 bp omitted]agtaaaaagaatgagtggacactagcatgaaactgatgttaaataataacaggccagatttatttgtctcttattacagaaggtgggatatgatcttacagattttctaagtggaaagaacaaggcaatatgatattattgcaaatgagctgggtcttatttctaagtggattgccaaattctttttctacctggatggggtagtgacaaaatgttacggaaatgtatctcctgtgttgcattctgaccacattttgaggtatactgtccatctctggagttcttacttggaacttgtatcctttgacgggtgatggagaacagagaatggattgccaagaaacaatggggacaatattggagtaagtttggaagacaacaggcaattccccaaaaagaatttccatatgtaactttcacagcatagatttcttatcacgtgctacaaatacaaacaataaaaacatatgatggtattaatattaaaaacttataaagcaaattttattaatgaaattcagcaatacccctttgtttcaagtatctttggtgattgaataatatttgggtcaaaatctgttacatatatatgatcagttttagtatgtctgcagcaactgcatttttgcactaaaatcctttttacctaaatgtgtagttggaaatgctaccatagaaagaacaagtcagatgagtagatttttcagtgatttctaaataatttctttattccattaagctcccctctctaaaatcacctcccaaatcactggcctttttgcatatctcttgaaaacatttttttagtattatctactaaggtgtatacacaccctgagacatttgaaaaatgtgcagaatctgccacagttcatggtcgtacaggacagttctgtactttgcaaaattgctaatgtcccatgccatttgtgctcaccaaacattgtggcagctataacatgttcccaacatgtttacacaagttcctccaggagatgatactccctattgagaatcgctagatttgacagagagaaatggcataggcatttcagccaggctgaaaaagataggcaaagactgaatttgctctactcagagttataaagcgagtgtggtttagctgttgtccgaagcacaaagagaaagatcagattcgttgattgattcaacacatgttatccagtacctactgtgttccaggtactgttttggcactgtcaccatataaactgtctccagtattttctactttgttcttttagcacccatttgtcaggagtgccaaaggagtgtcaatactgcgagacttaattaatgaagccatggatgtgaaactgaaacgccaggaatcccagcagcgggaagtggaccaggacgatgaagaaaactcagtgagtggcagccgttgctgtgggcctcagacattgatgcttgttattttatgattgccaaaccaggtaagatgagtaggaggtattggatcaacttggagctggagatgcttccagcataactatgtcctaacctggatcaacgcatgctagagggttgttgtatctgtgcttattcttctcccagtgcttcctaaaacacttttaaattttactctttgcccctcttttactcaatttaactttttattttagagagagaatgctcaggtctgggacttggcttttcatatccttttggggaatctgggatccatacttaacatgtagcttttacatttatagacttcttcacaaccctgagattccaaagatgttcacatgagtttcttagatctatgtcacaaaactctattaagaagagtagaggaagaattcctttagggttagatacactgcttattatcacgtggataaatttgtcttctttgcttaagtaacagcgctttcatttctggaaggtgagtttaggacctgaataagtgttaaatctcgaaatattttcactaagacaggtagtagttattcagaaaactcaaagtcttttgtcaaattagccccaatttgagattgtatccttttacaggaagaggatgaaatggattctggcacgatggttcgagcagtgggtgatgagatgggcactgtccgagtagccagcaccatgactgatggagccaatactatgattgagcacgatgacacgttgccatcacaactgggcaccatggtgatcaatgcagaggatgaggaagaggaaggaactatgaaaagtaaggctctgagtaaattcactgacttcttagaccaagcatacatatttcagagaagacagattctcatggttcatgcaggcttagccttgggttctttcttttgtcacaaccaaaggagtagaaaacttggaagtttgcgatggggacaggaggtttggtgagggggaaagctggcctgtggagtcaaagtcaagaaagcatcaacagtgagaaagaattttgcttttgaaccagagcagccattttctcattgaatgttgttattattttccttccttaccttgatctttggaggcaagcacatgcattgtttgatgcataattcctgtgaaggtgtaatgacattctgagttatttactgtacatacatcttcagtttattttcatgacagtttgggtctaacccaagtttaccaatactgtcagtcaatgaaagatgactgtacaagttgaaaagttctatccagtttcttctagtttaaactcatctctgcttctgtccgtatctggctgatccttttttgcctgtgactaggcctaacatcttgtgttcagctcctatcttagagtgaaattcttgtgtcattcagtgctcgtggtgctttatgtttcatcccctaaactcaagattaaggcactgtagaaatcccatgtttgatgatgtacaaattatcaactaaatgccatgtactagattgcccttctcctcccctcctgttttaaaagtagccagtatgatttgttagtaatgttcattttgcagtaatgagctactgacctctagttattttcattgactctgagtactaaattgtctacttgtcttaaggggtttaattatgtagatgattataaccgctgtgtaatacaactaggccaacctgttagtatgtgttgtacatgcacgtgttagggaaattgtgcccatttttatttaaagaattaatttttttccaaatgtgattttcataattcaaatgctaattcaatgagttgtttattcttttcagtttctgaacttgttttcagaactggatagttttagcatgtctaatgagaaacatgcatcttttattataatcatgaagagaactgtttaaaaacctaagcagtcacagtctgagtaacattaaatacaatttgttcacagacagtctgttgcagattttgtaattctcccttttggattacagatttgacagatttgccacttattttgagatttttaaaaattccttattgttttaggagttacttaaatttatcattatggaaaattaaaacatacatacaattacacagaataatataatgacccctatagacctatatcactcagcttcagcaatgatcaactcactgcccgtcttatttcagccccacctcaccaaaaagcaattagtaaacactttgtaaaagtattcatttttaaggccatgaaaagcagtgagaggagtaaggggtaaaaaagattcttaaggtaatgcaggcttcaaagtcctgatttataggacatgctatgacatcagtggtattttgggcaagatttttttttttttctgataataactctagaaaatagtaaaatgaattaattcaaagtaaatctgagtcatcataccatttctttataattgattttaagtatttatttaagttattatttttttaacagatagggtcttgttcttgcccaggttagcgtacagtaggtatgatcagctcactgtaaccttgatctcctgggctcaaactatcctcccacctcagtctcccaagtagctgggagtatgtataggtgtgtccagctaatttttaaattttttgtagagacagggtcttgctatgatgcccaggctggttttgggctcctggtcttaagtgatcatcctgccttggcctcccaaagtgctggaattagaggtgtgagccacctctcctggcctgatttaatatttaatattggaccaggtacaagcctggggctcagatactgatctatgtggtgttagataattcactttcctcctatgggtctcagtgccctaatcagtaaaattaaattattactaaacttgtttattttcattgtcccttattcctctaatagtcaacacatttataaaaattgtgtaattcatgacttgcagaactgaaatttctagaggttaaaatttgtgaaaatggatagactttcatttagttccttatttgaacctctatgaaatgtttatccttggaaattaaaattataaatgttaagggaggctatgcatgtgtggcagggagtatatgggatatgggaaccctcctttccttcctctcagttttgctgtgaacctaaaacgtctctaaattttttttttttttttttttggagacggagtctcactctgtcgcccaggcttggagtgcagtggtgcgatcttggctcacagcaacctccacctcccgggttcaagtgattctcctgtctcagcctcccgagtagctgcgactacaggcgtgtgctgccacacctggctactttttttgtatttttagtagagatggggtttcaccatgttggccaggctggtctcaaactcctgatctcacatgatctgcccacttcagcctcccaaagtgttggaattacaggttgagtcactgttcccggcctctaaaaatgtctttaaaaaaatgataactgttggttagtccgagtgcagtggtgtttacaactaattgatcacaaccagttttttctttttttttgagacggagtcttgctctttcgcccaggctggagtgcagtggtgtgatcttggctcattgcaacctctgccttctgagttcaagtgattctcctgcctcagcttcctgtgtagctgggattacaggcgtgtgccaccatgcctggctaatttttgtatttttagtagagatggggtttcaccatgttggccaggctggtcttgaactcttgacctcaagtgattcccccatcttggcctccccgagtgctgggattaaaagtcatgagccactgcgcccggccacaaccaattttttctttgtttttctccactcccactgtttcacttgactagccttaaaaataaaaataaaaaaaaaataatcttttaagaaatgcctgttcatgtcctttgcctaatttttcatggttttttttttcttgtaaatttgtgtaagttccttgtagattctggatattagacctttgtcagacgggtagattgcaaaagttttctcccattctgtaggttgtctgttcactctgatgatagtttcttttgctgtgcagagactctttagtttaattagattccgtttgtcaatttttgcttttgttgcaattgcttttgatatttttgtcatgaaatcctttttttctcctttttttttttcttttttcttttttttttttgagacggagtcttgccctgttgcccaggctggaatgcagtggtgcgatcttggctcactgcaacctccgcctcccaggttcaagcgattctcctgccccagcctcccaagtagctgggattacaggtgcatgccactacactcagccaatttttttttgtatttttagtagagacagggtttcactatgttggtcaggctggtctcaaactcttgacctcgtaatccgcccgccttggcctcccaaagtgctgggattacaggcatgagccaccgcgcccagcctcctttctttccttctgttggattgattgagtcctcaccgccatcacttcctttcccttaccttaatcccctctctccactctcttctaccaactggcaaagtgtatgcataagtatatgcttacttaaatttctactttcctaataaatttcaaagttaatcagtatctctctcctcttcctgaataagaaaaaggatttaagacacttcgcctttttttcaaactgcctctctcatattttgttattgttgtctattgctttggttcaccaggtttttaaaaaacattagcagctgggcgctgtggctcacgcctgtaatcccagcactttgggaggccgaggcaggcggatcacgaggtcaggagatcgagaccatcctggctaacatggtgaaaccccgtctctactaaacaaaatacaaaatattagccgggcatggtggcaggcgcctatagtcctagctactcgggaggctaaggcaggagagtggcgtgaacctgggaggcggaggttgcagtgaaccgagatcgcgccactgcactccagcctgggcaacagagcgagactctgtctcaaaaaaaaaaaaaaaaaaaacaaaacgttagctactataatcattatttagagtcaatacaatttatgaacatagtgagctactaatatgtttgcttacctttgcttctttaagcttatactttatcttatgggctcatttttcttctcctttcagtaggatgtaatgggtagcaaacttttataatttgtatggttaataaaagtcttaatttttttctcttttttgaatatagtttactgaggcatggatttctaagtggactcttattttctctttgtactttgaagagatcattttgatattttctggtatctgttgatggtgatggaaattctgttgtcaatattgttcttttctagatgatttacttttttctctttttttcattttcctgaatattttctgttttaacttattgtctctatgttggattttttttttccttctaattctgcttcttctggctctgtacttttcaatctaaggacccaggactttattcagttttagaaaattctctttggtttctctattattattattttttctaggatttctttttctccttttttattttatttttgtttcattttgtttcggatgtatttatttatttatttatttatttattcccagaaatgtggtcttgctatgttgtccaggcaggtcttgaactcctgggctcgtcatcctcctacctcagtctcccaagcagctgggactacaggtgcatacgactgctccgggcttgtcttacagatttttttctgtttatctctttgaacatttcaatttccctttaaaaaaaaactttcagatcctgctattattttgtgttttttgggtctaatttttctgtttattgtgtttgttatctctcatattgttacatttcttcttacactttgtaaattttgtttttgagcttatgtttggtgagaattatcttgctcggaggtcctttgtattccttgggttgtacaggcatccctagggccctatggggtatttctttctagagcagtctttagattatttctcagttccacattggacttgtggtacagccaagggaattgtatttctagaagttgattttttccacctcttacctaccgaagcagaagccatttttaagccatcttcttaagcttctgggcagtattgtcctggctcctatctttatgctgggaattgagttctggcttcccctttaacaggtatgtcttgccttctgccttatcctgattgctatttgcacatctgccttaaagctaaagtccttgtgatttggttttcccagtaggccactcggctcagtgctgtgggtttctttcccgcttttggcatctggaagttttcgttttctggttctgagcgctatgggttgttttttgtttgtttgtttgtttgttttttaagtcttgagtttctgtttgtttataacaggaggggaggccttagcacttcagctcattccgttatcttaactgtctacagagatgatgtttctccactttctctataaaggaacaggttcagagagattgagattgttgcttgttcatggtcacatggctagtaagtggtggagctggaaattgaaagcacttcagagttggctggacgcagtagctcacgcctgtaatcccagcactttgggaggccatggcgggcagatcacaaggtcagaagatcgagaccagcctggccaatatggtgaaaccccatcttaagaatacaaaaattagctgggcatggtggcgggcgcctgtagtcccagctactcggaaggctgaggcaggagaatagcttgaacccaggaggtggaggttgcagtgagccgaaatcgcgccactgcactccagcccgggtgacagagcgagactccatctcaaaaaacaaacaaacaaaaaaaagaaagcacttcagagtctatgctctcttcattccacagagcttctgatttgttttggttgcctattatattcataggcgttagatccataatagaaaactcatcatagttatggtgattctggtgctgtctttcactgagaatccagggatggcttttgtttgttcgaaacaattgtttattcatttatttatttaaaaaatttcaacttttattttacatacagggggtacatgtgcaggtttgatgcataaatatattatacccaggtaatgagcataggacccagtagctagtttttcgacccatggtcccctttctccctctcacctctagtagtctgcaatgtctgttattctcatgtttatatccatgtgtgctcagtgtttagctcccactaagtgaacacatgcggtatttggttttctgtttttgtgttagtttgcttagaattatggcctccagctccatccatgttgctgcaaaggacataattgcatttttttaacggagtcttgctctgtcgcccaggctggagtgcgttggcacgacctcgactcactgcaacctctgcctcccaggttcaagcaattctcctgcctcagcctcctgagtagctgggattacaggcatgtaccaccacaccaggctaatttttgtatttttagtagagacagggtttcaccatgtcgtccaggctggtctcgaactcctgacctcaaatgatccacccgccatggcctcccaaagtgctgggattacaggcgttagccactgcgcctggcctaattgcattctttttttatggctgcttacacggatggttgcgtagtattccatggcgtatatgtatcatattttctttatccagtccactattgatgggcacctaggttgattccatatcttcgctattgtgaatagtgtggtggtcaactcatcgtatgaatgcatgtgcatttttggtaaaatgatttattttcctttgggtatatagccagtaatgggattggtgttttaagttctttgagaaattagcaaactgctttttacagtggctgaactaacttacattcctaccaacagtatataaccattcccttttctccatagcctcaccagcatctgttgttttctgaccttttttttagtaatagccattcttactggtatgagatatctcattgtggtttggatttggatttctctgatgattagtgatgctgaacattttttcatgtatttgttagccacttgtatgtcttcttttgagaagtgtctgttcatgtcctttgcccattttttaatggaattgttttttgcttgttgatttgtgtaaattttttttttatagattctggatattagacctttgttgaatgtatagtttgtgaatattttctccctttctgtaggttgtttacactgttgatagtttcttttgctgttgtgcagaagctctttagtttaattaggtcccacttgtcaatttttgcttttgttgccattccttttgaggacttggccaaaaactttctgccaaggccaatgttgtgaagggtatcgcctaggttttctttttggatttttatagtttgaggtcttacatttaaatctttaatccatcttcacttaatttttatatatggtgaaagataaggatccactttcaatcttcttaatatggctagtcagttatgccagtaccatttattaaatagggtgtcctttacccattgcttgtttttgttggccttgtcgaagattagctggttgtaggtgtgcaggtttatttctgagtttcctattctgttccattggtctatgtgtctgttgttgtaccagtacaagaacagcattctggttactatagtcttatagtttgaagtcaggtagtgcactgcctctggctttgttctttttgcttaggattgctttggctatttgggctctttttggttccatataaattttagaatagttttttctagttccgtgaagaatgtcattggcaattttataggaatagtatggaatctgtaaattgcttcggagagtatatacattttaattatattgattcttcctatccgtgagcatacaatgtttttccatttatttgtgttgtctctgatttctttcagcagtgttttgtagttctcctagagatccttcacttccttggttacctgtattcttagatatttcattttctttgtggctgttgtaagtaggattgtgttcttgatttcactctcagcctggccattgtttgtgtatagaaatgctactgatttttgtacatttttttatcctgaaactttactaaatgtgcttatcaattctagtagccttttgacagagtctttaggattttctaggtatagaatcatattgtcagtaaagagagatagtttgacttcttcttttcctatttgagtgcattttatttctttcttttgcctggttgttctggctaggacttcccaattatttatttgtttatttatttttttctgaaacggagtcttgctctgttgcccaggctggagtgcagtggtgcgatctcggcttattgcgacccctgcctcctgggttcaagcaattctcctgtctcagcctcctgagattgggattacaggtgcatgccaccacacctggctaatttttatgtttttagtagagatggggtttcaccatattgggcaggctggtctccaactcctgaccttgtgatccgcctgcctctgcctcccaaagtgctgggattacagtcgtgagccaccgcgcccggcctcccaattatttattatatgtaacttatgtgttatactcaataggatagatgttataactgctaataataattattagtgattaggcacttaatatataccacacactgtgatttatcctttaagcatttcacatattttgatcattacaaccatgctgtgtggtaaattgaaccattccctgtttaatagcagttgaaacccagttgcagagattaagtaacatacttgtgattatataatgagtaatagagaagccaagatttgaacccagatatgtttgatttcagtggttatgttctgaatcattagattatactacttctagcagagcccctttatcaagtgttgggagctgggactaaggcttatgttacagatcatgtgttggtgagtctcagcttgtagtaatgtacttctccttgctggttattttgataaccagttactctacatatgtcctcagtatttccagaaagaaaggacagatggttttcaaagggagcatgcctctgataagctaatgatattgttacctctgagggaatttgttttggatgtatgtatctgaatctataggaaggagtcagattgcagttggagagaagggattaaggtgggatttgattgattttaagtggcctcaagcatacatgtgagaacgaaagaggcaaaccatggtccacgttacttggaaaacctctgtctggataaaatattagattggggattttggaaggcttcttctatttgtctagatatgttcttgtttttgttgttgtttttgtttttgaataagggctctagaatagccttgtttacctccccaaacagcaggacacattattgaagtgacatgagagggtctgtgtcagtgttaggatcattgtgcattctctgggccagcagagggagctctgtattaagttaatgggttataatcgtgttcccatttgagttcacaaatcccctttatataaaagtagcctttatgctagaacaagaccattacttattcattcttaagtgtattttaagtaaccgcagtgacactagggcaatgtctttattttatttagttgggagattggatacctcatacttggcaaagttcaaataagaagtcagccaaaacatctcaaaatagtcactttttctctcccttcccagatttctcagtggacttgacacaattggtgttctttttctgtagcatggtaccatgcatatagtttttaaactgtaatcagctaaaatggccttacttgaataactgaataaattttttaaaaaacctaataattcttgtgtagaactgatttgaaagttcttgtgtagaacatacatatatatatatatatatatatttttttttttttttttaagtcaagttgttgggagccaggactaaggcttatgttacagtaaataacagtaaaaatatatatattcctgatatagatcaggaatttgtttttgtttacaatatgagctctagtagtctgttttatttttccatctgaaagacttgcttcctccctctatccaggtctttgatcctgtcaccttctcagtccttctttgactatttgtctgcaatagatttcccatccccttatttttcttttcatcacagattacttcttgaaatttatatcactcttctccgatacaaatttttttttttttttgagatggagtcttgctctgtcaccaggctagagtgcagtggcgcgatctcagctcactgcaacctctgcctcctgggttcaagcaattcccctgtctcaacttcccaagtaactgggactacaggcacgcaccaccacacctggctaatggtttgtattttagtagagatagggtttcactgttttggccaggatggtctcgatctcctgacctcgtgatccgtccacctcagcctcccaaagtgctgggattacaggcgtgagccactgcacccggcctctcccatataaattttaggatcagtatatcaaattttataaaatactactggaattttgacttaattgcattggatacacagattaattaggcagaattgccatctctgtgttaattctttctatgcatgaacatggtttatctttcaatctgtttggtctatcttttatattcttagataattttataattgtaccaacaaagatgttttagagctttttgttaaatctatttttagatacttatttgttgctattacaaatggcatagtttaaaaaacttttgtttctaacatttttcttctatagacaactactgtagatatttatggactgttttattcattgtaacaggttttatggagattgcctttttaaaaaaatggagacagtcttattgtctatgaattatgattatagtttttccttttgatctttatatataatcttcttcttcttcttcttcttttttttttttttgaggcactgtctcactctggaatgcagtggcgcgatcctagctcactgcagccttgaattcctggggccaagcaatcctcctgcctcagccacctgagtagctgggaccacaggcatgtgccaccacacctgtgatttttttttttttttttttttttttttttttatagagatgggatctccctgtgttgcccaggctggtctggaactcctgggtgcaggtaatcctccttcctcaacctcccaaagtactgggattacaagtgtgaaccaccaagcctggccaaggtttttttcttattaagacctccaatacagtgttgcatagtagagctggtagtggacattcttgtcttgttgctcactttaaagaaaattcttgggattttttaccatggagtctgattttgcagcagaatttggtcgataccccttaacaggctaaataagttttggtttatttttagtttaagaggttttatttaaaaaaaattctttaattaatgttgttttgtctttttttaatttgaatagttagctttttaattttcttgcttactaatacatttaatcaacattgtaactttttctcttagttctgttttagctgtattccatacattttcatatgtggtatattgtaaatatttttttccagtgtgtagtgcttgtgctatacacatttattttttaacccatgagttattcggaagtgttttttaatagcaaatgtatgatttttaaaaactgcttatttaaaatttttaatttatagaattgtggttgaagagtgtggtctgttatatcaattctttgttattttttgagacattgtggcctaacatgttattaattttcattaaatgtgctttgtgtgtcttaaaaataatgtattttctaattgtttggtgcaggaatctgtaattagcaatcagttgctaattgtctttcatttgtctatctttaccaatttttgatacttgatcttttagcttctggagatttgttaaaattgttaaattgttaaaattgtcactgtgtggttgtgggttttgttaattttggtattactcacatatgtcatccaaaataatatactggtggcactgaatacaattggtagtactgtgaaaatgatggaattttttgcatattttctcttttatattaaattatatattttctctttcttttatcttaatatgcagaagaatagtttcaccattatccgttttcaagcaaccatttttttaaagcagaagaatttcttctgttttatttgatcattatgaaatagggtgttaatatttagagctaaaatgaaaacggtccaggatgtggtggctcatgcctgtaatctcagcactttgggaggccgaggtgggtggatcacttgaggtcaggagttcgagaccagcctgaccagcatggcgaaaccccatctctactaaaaatacaaaaaatcagctgggtgtagtggggcgtgcctgtaatcccagctactaaggaagctggggaaggagaatctcttgaaaccgggaggcggagattgcagtgggccaagatcgtaccactacactccagcctgggtgacagagcaagactgtctcaaaataaaataaaataaaataaaatggaaaggattaattttatacttgatgtagaaagaatccaagctttcacaacattattaaatatttaaaaagtatatatttgaaagcaaaaaaatattttttttttagtggcaaagataacaaaaacattttggagcaactgaagtagcttgatttgcacagacttgtagtttagcagttaaatgcttttgcccctcatgaggaaatgacaagccaaaggatggccacttgcagtaacatgtactcatccactaaagatttgacatgcggcggttcttcctctcaggattcattggcgataatgtcatggttttcttgtccttaccacattcccaagagatgcatagccctggtcacccctcctcatctccaggcttaataggtcaatgggaggcagaacttggactactaattgaaagaatgtttcccctgaccaagccttcaaattagattcagtgaattgaagggagtgagatgatgattcctctttaaaacttgtacttagtgcataagattctaatttttctcccagagcaacagccacattaatctctttgaaacagaattttaaagcataatgacataattaagttagggcaactaagagacatgttttagttaaattactgagatagtattttgtggtaaaaacattatgtgtttatagttcctcagaaagtcctaagtttcatgaaggcacctattgttgctgtgagtttcctcatgttgaaatcaggtgaaaggctaggctgttgtcaaaatgattttacttcaacaccgtccatcagatactgatttcagagctgcataagataggaattcttgactcagagcctattttctttccatctgcagtttgaaaggggttgttagaacattgtctcccttgtgtgttatctgtcttattctcactgactcagattatggcatttgcaagtacagtaattaggacataaagtactgcaagtattttaacacttcttttaccacggtagccttactgtccaatttctgatcccttcaggatttaaacatctatcatcagagtattgtgttggtgtatgcttgccactcacagtcagcatcacatgagagtttcagacagcattagtccagttatgcaccccaaaactaaagctgaaaacatttgattttgttggaaccctatctctgagtaagggcaagagaaggacaaaggagtagtggagtgaacattgatttttagcatcagtctttggcttgaaactttgctcagggtcttacagactacgtcaccttggtcaggttctttcttttttgatcctcagtttccttgtctgaaaaaatggggcaccaaagttcctattttgtagttttgtcaagatgatatgagattgtatgtgtaaaatatttaatgtgtaaatgctcaaaaatggtaggtattatagtaagtcttttaatgtatgagagtgtttttttcattggacgtaaacatttcttcaacagtgctacttttcttcttcctaattccttttctcttgatactaactttttactaacttttagtttttgctcttggtattgatgatgttttgtaggtgccaccccaggaatgcctgagtgctggcatgaacatggttgagctaagggaaggtcacttgtcagtttcagtaacattttaccattgtgccgagaagagagagggaggctctgtgtggtttgtgtctgtgtgtgtctgtgttttaaattccttggcaataagatgatacatgttttgagaatctattaaatagcccagaatacaaggtgacggatttttaagagggccagactttagatacacatgagccttcttttgtaaagtttcagcctcttatcttaatacagtggaatttattaccgactggattttttttccacccccgaaagataaccactgtggttcactgtgcattttatcagtagctccctcgtgggtgagatttacaatagaagagcagacatcttggtacttaggtttttctcacagtttcaaaaataattcaaggttgtcctgccagagtggagactaaatcctaattgtttgtgcagtttttcttattgtatccagatgttgggcccccttttatctttggaaaccattagcattcttgattcttttggaatgagccaaaaagcacagaactcctgatgcctgaaaattcattcagaacaccctgccagaccacattttaggatatgaaagtaccagatctcagtataacttgagtgaagggctcaaggcctatatattttgaaagatagctactccagtatagttatattggtaaaaggagagccaagaacagccatgagggaaatacatttttcaagagagggcagtagcataatggtaatgaagaacataggaaagtgaatcacaaacaatatactttggtccttaagcctaagaggcagataaatctttcttcatcagttagtggaatatattatttctctgttgctctaagcttgctgttctgaccttcttttgttcagcaagaaaatggagatacatttttaaatatcaatttaagtggatctataaagaaaaagcagatgattcttttcaaatgtttatgctctataaatatcaatttggaatcagtatttgtttataatgaatatttaataccaaccaagaagcatttattaaatagtcactatgtgtcattaacatgtagagtatgaaaaccaaatgaggcattcactgctttcagtaacttatatattaaaaggggaagatgacatttgtcattatcattatctaatacttatggcatgtgtactgttctaattgttctaattccttatgtgtatagagcattactctaggcgcttcaaataatagtatttgataatgatgcgacgtaggagaaaggacttctacatatgaaggtaataatatactaagacaaatgctaggtaagtggtacaggaaagcgttaaaggatttgtgaaaaggaaggcaatgactcagatatgcaggaaggctggggaaggatgttacaggcaggtgcaaagtcagaaaggtagaaatgtgttttcattattcaggttggccgaagcagatgtgggtgttgactggattttggaagactttgaatttgaaagtaaggagtttgaacctgattctcttgttaatagggtatctgaagacactttgactaggaaagtgataaaatggagtttcaaaagactgtaaaaggtgagaccaattaggaaattcttgcaagaaccaagatgtggaccattctcacctgtgaacattttttatctttttagatgtgctgccactattgctctagttagtaatcctttgaattttggatttagctctctttgaatttatatatttcagttcaccagaattaaaacagctagagcaccattgcccagaaattaagtccattcatatagaggcagttactgaaactgcttaactggaagagttattctgggctccagggaaccttataacttatgattccagcaattcttagtggtttcaaaggacattcaaaggaatatttatggctgtacacagctacttggatagtaaccagtgtaattaaatgagctgatacatgtaaagcacttaggtgcctggtaacaaaaacaaaacccaaaaccacacactcataacaaatgttagaaaaaaacaaaccctgtgataagaattgcacattaaggcatactattccaagccagaggaaaacatttgcaggattaccagagttgttgttgttgttgttgttgttgtttttcctgcaaacattcatgcatgaaacagagaaaaaaaatcaggctctgcccagttctctggtttgcacagaattaattacaatttaagtagaaaagagtcattgtaggaattaaggaaacagtaggttgaccatattggtttacttagtgacagtctggaaaatgaaggtttgaaattgaaggtcatgaagtttaaggtctagtagatggtcattccaatggaacagtgggcttcagtctttggtcaaggtccttcccagttatgactacctagacattatgttgtagttcatatgaatccagaaataagagcaaatagttaaggaaaggtgtcttgctgcttaaaaaaaattgagttactgacatataatttacacaccatacaatttgttcatttaaagtgtacagtttaatggtttttagtttattcacagagttgtgcaaccatcaccacaatctaatttttaaaattctatctaatttttaaagttctactttttttttttttttttaatttggagacaggatcttggtctgttgcccaggctgaagtgcagtggcatgagcatagcttactgcagtcttgaactgggctcaagtgatccttctgccttagcctcctgaatagttgggactacaggtgtgcaccactatgcccagctaatttaaaaaaaaaatttttgtagagacagggtctcactatgttgctcaggctagtctcgaactcgtggcctcaagccatcctcctgccttggccacctgaagtgctggaattacaggcatgagccaccatgcctggccactatttttaaattgagatataatttatatgtcataaaatttgccattttaaagcatagaattcagtgtttttttaggatattaacaaggtgttgcaactttaagcactattgaattcaagacatttttatcatcccctcaaaaaactctaatcctgttagcagtcacttctcatttgcctctcacccccaggcaaccattaatctactttctgtctctatagatttgcctgttttggacagtttatgtaaatggaatcatataacatgtggccttttgagaatggcgtctttcattttgcataatgtttttgaggtttatccatgttatagcatgtatcactatttctttttgttgctgaataatattccactgtatggatacactgcattttgtttatctgttcatcagctgatagacatttgggttgttgattccttctgcttttacgtagcatttttcaaagaaaaataaatggaagatacagttgcttatgaattcactgctttgtctgtaggcttagacagattgttcatttagcttgacaaatgctgcttacaaagaaaaataggccagtcttagcataggaattcatgcatttccggcatcagataaaagaatcagagcaagatgtggtattttcaaggcttgatttctctcttcagtccattctttctacggctttaggtttcttgtattatcattcagctgaacatctttatttcttgggatacatctgaaaaaatatgctagctcaagttaaaacaaaaaacccacaagctagctgaagccctgggggacagcatggcctttaatcagcttggaatgattctcttacacttttcaacctgacaagctgctgtccagcacacttgatcatctatctagctaacgggtgctgaaagaaaagttcaaagataaggttactgggaaaattacatttccccactctttctgcacttagtttaatggcagttctaacatgtcaagaatctttattttgattttagagactgtacaatatgagatgtagatcactaaacttaaaacctgacatttggcattcaagtcccatccttgttggttactagcttagaaatctgcaaatttctcacttgtaaaaggggcataataaataacatatatctcaaaagactctttgaggattaagtgatatagtacattttctggcacttgatagatgcctattaagtgtaaggcttttccccctctactttatatggtggtcatgcagtttggatgtgcagtttggatgagaccattatgtgaaagcacctagtagaaagcctgaaatgtagaaggtatttagtgaatgttagttaaatttgaacctaagtttccaaagaatagaactcttttttccagatttaggggtgtatgtttatgcgtgtgtgtgtgtgtgtgtgtgtgtgtgtatgtttatgtttatgtttatgtttatgtttatgtgagatagagatactgaaactgtgtcagttagcttttgctgcattgtaaaccaccctaaaatttagtggtttaaaatagccattttatttaacttgattcatgattctgtaagttggcagttaggttggactcaggtaggcaggcaattctggtctgagctggttagctctgctctgtggtcagctggtgcaataacagctggggatggctgatttatttgttgagacatttgttgacttgggcctctccacgtagtatttcaccatctagcaggctcaatcaggtttatttatattatagtaaaatatacaagactttttttttttttgagacagggtcttgctctgttacccaggctggagtacagttgtgcgatcatagctcactgcagccttgacctcctgggctcaggtgatcctcctgcctcagcctcccaaatatttgagaccacaggtgcgtgccaccacacccagctaatttttttaaaaaattattatttgtagagaccaggtcttgctatgttgcccaggctggtctcgaactcctgggctcaagcagtctacccaccttggcctccaaagtggtgggattacaagcatgagccaccatgcccagcctacacaagaatttttaagtctcttcttgctgtacatttgctattgtctcaatgcccaaagcaggttagatagccaggcccagagtcattgtgagagggagtaaggtaaggatgaagataccaagaggaaattgttgtggccatttttaaaaacaatttatcttagatactaattgtgataggaatgcaaatctgtttactgagaattattatcagtctataaaatcagacttagtacaggtgctgcaatgtaatgacagtgttattcacaataggaatactgctgtcttcttcatataaacttaacatgtcagtaaagcactctcacacatgaagaaagaatcattatggtggaggcatttattttctggaatcactaaatacaaggatcagctaattgtttttgaatgtctgctgtttcttgccagttaaggtggcttcccctatcagtcagttcattcagtttttcactttagttccataaaatatttcatctgcatctctagacgatatctttattacagtttgagttacctcttccatctgttaaaccaccaacaacaaaaaatccaaagaatcagagatactcttgtcactaaaatatttcttgagtcttaactatttttcactttggtctttgctttatgcctgtacacatctagttgtagcatgttttagatgagaggcatccagtatcataatcctactagagataagaacttcttcttttgaatagttattaataactgagcataaatatgttttcatatgctactgccaagtcataaaatcacggaatttttcaaagctgcagggaacattagatataatctggccctgtgtcttctttttgcagattgggaacctgtggttttaccaagatcgtgtagtcagaaccagaatctaaatctttgaactgcaggatagggattactttccatttttttttattgtggtaaaatatacataacataaaatttgaggagaggaatttttccgttcttctgtctccaaaatcaactttagctttttggcaatctgataaatgtaacattttaactaatcattttgctataattaaatttctaatacatatgtgcattttacttacagcttatatctgaatatgtggttagataaaaaaaattctctttttatttcactttagtttttggaacttcgaattctaataaatgtcaggtataatcaggtccctggtattgatatcagaaggtaaaagcaaatacattttagatagactttcttatttgtggattttcattgttgaaagagacaaagaacagttggtgttttaactccaaaaattagaaatttttaagtgggttggtaagaaagaagaactcaaatatgaggcaagcagatgttctcactttttcatctgaacagtgacagaaatagacaaataattatattctcacttaacagacatttctttgatttttatgacatggtttagaattagaccacagaaatgttatctttagtgtttcatcatccttggtttaaagattcaatttcttaagtccacctgtattgcaactgaaagtaattaatgaagaaccatagaaatatattgttttattgttggatataatacattttaaaaaagaatgacgcccttatggtttttgtaaattccattggagaaaaagttttaaattacctgttatttctgtccagaagtcgccatttttattgatgaactcaatttagtcatttatctgtgcatatataaaaatgaatggatggatggataaacagacgtgaatgacagaaataatgagacaagagaggttggtgcgtgatatatgcagcttactctcaaattttaagtgtgtatttcctaagaaagaagataccctcttttgtttgtatttcctacaaaggagttgctcttttttgttaccacaataaagtggtcaaagactgatttttcctttttatttcttgggaccgtgtctcactctgtctcccaggctggagtgcagttgcatgatcatggctctaacatcatacctagagcacacaaaacaaaacaccatatacttgctgattggtcctagcaaataatgtatttaattcttaattagtgaggagaaaacagtgtagtaggaaaccattggcagtctgtggatatgggcagatacgggattggctgctgttgaacttagcaatggtgatagtgagaaaaatgacaaatgttctgagaggtagggtggctggcctgaaactggactaggaagtgtcatgaaataagtaagattgcatagaccaagggtgcctggagagaaacacttgctgttctttatcttctagataccttctcatctacttcttaaggtgctgagccttctggttgtttttcctgattactgtaggaaagggccgtataaacccctatgttcatggaaagcaatgaaaaatacttcctgtatttccctgtattagaatactaatcagaggcacaaagatacttcaacctttgaaacaggtacattcagctagtttgatttttaaatcatgccaggtaaaattattctttctgctcttgttactaataactaatagctgctgtattctgctctcttaacggttactgctactatgtaactgctgatgcttttctccaggatggtttgaggccccatctaagtccccttttaccagtcttccctgaccacacagcatgcaagaactgggcacatataattcttttaatcaattctatttattttatacctgttcaatactaacttctttttttttttttttttttttttgagacagagtctcgctctgtcacccaggctggagtgcagtggcgcgatctcagctaactgcaagctctgcctcccgggttcacgccattctcctgcctcagcctcccgagtagttgggactacaggcgcccgccaccacgcccggctaattttttgtatttttaatagagatggggtttcatcgtattagccaggatggtctcgatctcctggccttgtgatctgcccacctcagcctcccaaagtgctgggattacaggcgtgagccaccgcgcctgacccagtactaacttatttaaaaaaatgttcatgagaagtaaataaaatcaccaatagtcctactaccagagataaaccctgttaacattttgggtattttcccctagttttttttttttcctatatgtatgattttatagagtcaaaatcatactgtatatataatactgtatcctattttttcctgtaagtttattgtaagccatatgtagatagtatttttaaagttacctaatatttcatagagtggatgaattgtgatttatttatgttttctttttcatgtatgtttttctcattattccagttagattatgagattatcaaagaaagtcaccctactgtatcatcccctcttcctacttaaatgcctatagagaatattgtatgtgatagatgctaaatatttttgcttgcttctgtctcattctaaatattataggagctgtttgctatgggagactccaaatgtattatttgcagattatcagaatcattgcatcacccaaatctttccatttagaaagagggaccccagggaaatttctgaatgtattttaggggaaatcttaactcctctggaattccatgagaattttttgggcaaggatttgtgcattttttgtagtttcactagattcttgaaggagtcctttatctaacagaaatatccactgatccagagattgtagcccatctggagatatgtctatttattaaacttacctaaaatttagaatgtttcttttcatttttcatttttctttgttttcaggaagggatgagaccatgcagcctgcgaaaccatcctttcttgaatattttgaacaaaaagaaaaggaaaaccagatcaacagctttggcaagagtgtacctggtccactgaaaaattcttcagattggaaaataccacaggatggagactacgagtttgtaagtagtgttggaagtaaatggttatgtcttcaggggaagttatttgaaatatcacacattagtgcccaagcattttcttgtgcattttgagtctcctaaaccatccctgacagtgtctactgagctgaaggacagtattttgactgatgtttgggcagttctctggtccctgattagtggcatctttttcgctttcgaagtccatattcagtttttatttttgtccagttagaaattgttcatggtgagagaagtattcaatcatcaaatgaaattgcaactgtctttaatagtttatttggggttttgattttatatttaagaattagattggagggcaattgacactgttttgtggtgtccttgttgttttgctaactattctcctaattttaaccctgctgaaaggattattctcagtttttttcagaggatgaatgtataattattccagtttcatatgaaaaactggatgtgttttcctttctctactgtggaacattttccctcaaccatagacacttattaatgttcataggcatttaaggagtagagcaataaaaattttgggaaaaagtaagctaaggagtctgcattttcttcttgactattactagaaaagatttttctcttcaggagctttttatttttacattctaaaattctgaagtttgatcctccatctgtcataattctgttgtttataaaagaacttagattgggcattgggcttgaattctggtaggcctgtctagttctggctttccactatactactgactggcctagaggaaatgacgccattcttccataacttaatttctacttttataaaatggcaggaatatcacagtttatacaactaatggtagagatcctttgaggaccagaataactcatctgaggtaaattaactgattagtcactgaacccatgatagaacccaggctatttgttttattacctgtttgttcatttacttacttatccagtggtttttttttttttttttggatgtcatgtgtttgacactattctagggatgtggtcattaacagaacagccaaaaacccatccctcatggaggtttcattctaggcgaaggaaaataagtatttagtgtgttaaatggtagcaactattgtaaaaaatataaagcaaaagggaggttaggagacagaaagagtgtgtgtgtgtgtgtgtgtgtgtgtgtgtgcatagttttttaaaaataagagtagtcaaggaagttctcactggtaagaagatgaggatgtgaactatgtgaatatctagaggagagatttttaggcagcaggaatagcagatgcaaagatcctgaggcagggacttggctggtatgtttacagaacaacgaagaaacagtctgttttggaatggcatcaataggatgtgcagcaggaaatgatatcagagatataatggagagcgagataatgcagggctttttgtgtaataaaaaggactttagcttttactcttgagtggaatgaaagaccattggaagggatgacttgaccttatttatatttaaaaggtattattctagttgctgtattaatacattataggagaactgtagcgtttctgaacacaggtgcagtgtttttatttactattcaaaggtggcaaattatggggcacatctgctactattctcctcttctaggcctttggcacccatctgttccactgaatcagggttcagcttcagaatccttcttaacacagcacaccaggctgccactgctaatcatagtagacttacgaaatttgaattattgtgcgtctgttccatgttgcctgtatagttgtcttcaacatgtgtataaggactgatttctcagtttagccagtcttcaggcaaagatgtttaactactgggtaccaaatcacatcattattgtgatagaatgcttgagaatcctcaaatctgtagtacttctaagcttagtttccttgtttttaaatgttttagaagttagcgattttggctaggcgcagtggctcacgcctgtaatcccagcactttgggaggccaaggccggtcaatcaccttaggtcaggagttcgaggctagcctgaccaacacagagaaaccccgtctctactaacaatacaaaaaaatcagccagtgtggtggtgcatgcctgtaatcccagctactcgggaggctgaggcaggagaatcgcttgaacccaggaggtggaggttgtggtgagccgagatcatgccattgcactccagcctgggcaacaagagtgaaactccgtctcaaaaaaaaaaaaaaaaaaaagaagttagcaattttgaaaacccagtcactttaatcctttttaattttaaaaaatattgtttatgatatttttaggatacatgtaatattttagtacctgttcataatgtgtagtgatcaaatcagagtaattgggatatctattacctcagacgtttttctttgtgttgggaacattataaatcttcagccgttttgaagtatacaataaattattaactataattttcctactgtactatcgaatactagaacttattccttctctctgacatatttttgtaccccttaaccaacttctcttcatccctctttcacctctttcccagccactgctaaccgtcattctacactctgtctccataggatccacttttttagctcccacatgagtgagaacatgtaatatttgtctttctgtctctgtcttattgtagctaacataatgacctccagtaatatccatgttgcaataaaagaagcgacaacatttctttctcttttctggcggataatattccattgtgtgtataccacatcttctttatccatttatccattgatggacacttgggttgattccatatcttggctattgtgaatagtgttgcaataaataggagagtttagatatcttgttgatacattgatttcctttcttttggatatatgcccagcagtgggattgctggatcatatagtagacctattttaattttttaaggaacctctatactgttttttataatcgttttattactttaaattcctaccaatggcgtatgaacattcccctttctctacatcttcaccagcatttgttatttcctgtcttattgataatagccattctaactagggtgagatgatatctctctttttttttttttttaagagatagggtcttgcttattctcccaggctggagtgcagtggtccgatcatagctcactacagcttcaaactcctggcctgtagtaatcctcccacctcagccttctgagtacctaggactacaggtatggatcaccacgcctggctaatttttaaattttttccaaagatgaggtctggaaatgttgccccagctcatctggaacacctggcctgaaataatcctcctgcccgggcctcccagaatgctaggattacagatatgagccactgtaccggctctttgtggtttcagtttgcattttcctaatgattagtgatattgagattttttcttatgactgttgcccatttgtatgtcttttgagaaatgtctattcaggccttttgcccaactttaattctaatcattattcttggatcagtagtttcaacgtgtaaagaatttatttctctttgccacagttttctcatactaagatcattggcaggaaacttgttttggtgggcaagctacttatacggaggagctttaggagcttttagagagagtactttttattttggaagtagatgacttctagggggagtgggcccatggtgcacagtgaccaggttagcacattgcatgacttgtattcctcctgagactttcttctaaatctgaggtcataaactggcagcaaccagctcacagacctttctgtgtgtcctatacggtgtttaaatttttaatttttaaaaattagttgcttatgttaaaaacttatgagattttacacaaaatgttggatctccagcttattttgaaaatgtgaaagatctggctacagtagacctacattattggttaatggttgtctggagctgagtggcagctgccctctttaggtatgacctctctaattcttcacactatttgacctacttcactcatttgtattaactgtctgacctgtctgacacttaggggcatttgatattgggactcttgcactaaattgtttggatttatatatgcttgagccagcctattctgatatatgacattctactctatttgtaccttcagaatgttaagataatttacttaataaaagtctcttacagaaaaatttcaaactaagcaataaaattgagatgagagatacatgagctgctctcccaacaaagatcaaatgaaaactgtcttcatagttgatattcttgttacatagcttttaccttgatcctaaagcaagcatttgaaataatagtctagaacagtggttctcaaagtggtcccagaccagcagtgttagcatcacctagagactgttagaaaggcagttattcaggccttaccccaggcagactgaataggaatatctggggacagcacccattgattggtgttttaacctgtcctcctggtgactcttacccactaaagttgttctaaaaggtttttacagtagtatatcttcatatacatttcttgttttcttttctattaggtactatagaaattcagagataaggatgtatttctattttattaacattgtatgatttttaaatttccttgttattccccttttgagtctcctatactcttactggaggtaccaaagaagcacataaaatatggaaaatgtatgtttgtaagtgacatctggcaaataaagagctagtcctttgagtgaagaaagttctgaataatctcctgaaagcttaacgaaggatatgtgtcagacttgctaacatgtttccctcacagttgcttttttttttttttgagatggagtctcactctgttgctcaggctggagtgcagtggtgacatgatctcagctcactgcaacctctgccgcccgggttcaagcacttctctgcctcagcctcctgagtatctgggattataggtgcctgccaccacacccagctaatttttgtatttttagtagagacagggtttcaccatcttggccaggctgatcttgaacacctgaccttgtgatccactctctttggcctcccaaagtgctgggagtacaggcgtgagccaccgggcccagcctccttcacaatctcttacagactttctgatttctaggcagatagtatttaattatgaaaaaagataattctgtttcctcctatgaagagaattgctgctttccaatgacctttttgcccaaaatggcaaataggaagtaatttaatcaggagtagccgaattttgtactgacaaaacttcatattttcatctgaaactgaatatttgtctcatttctaaaagtgaattgcctgtttgccaagttgagaaacccctccaaaaatttctaatagtgtttaagatacatagtgattaaaatataaaaggtgcttaaaaatgcaatagtctctaaaattgatatttcatattctattagcagatcacttttttggaaaaaaatgtaatattttgtgagaattcagaccttcccattttgccattcataaagccacaaacagctgtaaacttaaatccaatttggctcatgaatcttccaaaaacacactgtaatattttagtttaagatgacccaggctgggtgcagtggctcatacctgtaatcccagcactttgggaggctgaggtggaaggtttgcttgagctcaggagttcgagaccagcctggcacatagtgagaccccatctctattacaaaaataaaaaaaagatggcccaagtgccaacagtggtgaacaaaacagaccaggcccatgttctcatggagtttacagtgaaggaaatagacattaagccagtaccctagtaggtatcagttcaggtaataatagcgaattttttttttttttaaagcacagttaagagatattgtgagaaaaggcctgtggagagacaggacattcagctgagacatcagtgaagaggggaagcaagtcacaggaaggtaggggaaataagtacagagactgtgaggcaagacatagactatgtgtaaggaaggaaaggagtccattgtggctggagccgagtgacacatgggatagcagtttaaatgtaaatgcatcagtaatcacagtaaatgtgagtgcactaaaatctcctattagaagagaaagagtctggataaaaataacagtcaaattccggctaaatgctgtttataagagatgtaacggaaagaaaatacaaccgaaaagtttaaaacagaggaatggaaaaagatacactaggcaaatactcactaaaagaaagtgggtgaaacaatattgatatcaaatgaggccaagcatggtggctcatgcctgtaatcccagcactttgggaggccgaggcaggcggaccacgtgaggtcaggagtttgagaccagcctggccaacatggtgaaaccccatccctactaaaagtacaaaaaattagttgggcgtggtggcagatgcacctgtagtcccagctactcagggggccgaggcagaagaattgcttgaacccaggaggcggaggttgcagtgagccgagatcatgccactgcactccagcctggctgacacagcgagacttcatctcaaaaaaaaaaaaaaaaaaaaatcagatgaaatagaatttaagacaaaagaatgttacctgggaaggatatgttttatactgttaaaaggtatactttatctagaagatgtaagtcatgcacctatatgaaacatacatatttatcccaaactgatagaaatagaaggagcaatgagaatactgcaattatagtttcaagaagttaatcaagaagacttaaatattcttctctccaaaattgacatttcagttagacaaaaaactaacgcaattaacaacactgataaaacagaaaatagacaaaatttctaatatatatgaaactttaaaaacatggaatatttgtaaaacaactattttattcttttttttacctttatttcaggttcaggggtacatgtgcaggtttgttacacaggtgaattgtgtgtcatgggggtttggtgtacagattatttcatcacacaggtaataagcatagtaacccataggtagtttttcgatcctcaccctcctcccaccctctgccctcaaggaagccctgatttctattgttctgttctttgtgtccatgtgtactcagtgttgagctcctacttacaagtgagaacatgctgtatttggttttctgtccttgtgttagtttgcttgggataatggcctccagctcatccatgttgctgcaaaggatgtgatcttgctcgtttctgtggctgtgtagtataccatgtcaacatgtaccacattttctttatccagtctgtcattgatgggcatttaggttaatttcatgtttttgctattgtgaatagtactgcagcgaacacaacacatgcatgtgtctttatggtagaacaatttctgtgcctttgggtatatactcaataatgggactgctaggttgaacagtaattctcttttaagttctttgagaaatcgacacatggctttccaccatgattgaactaatttacattcccaccagcagtgtataagtaatcccatttctctgcaacctcgccagcatctgttatttttgattttctaataatagccattctgactggtatgagatagtatctcattgtggttttgatttgcatttttctaatggttagtgatgttgagtatttttttcacatgcttattgaccatgtgtatgtcttcttttgagaagtgtctgttcatgtcctttccccatttttaatgaggtcgtttgctttttacttgttaatttgtttaagttccttacagattctgaatattagatctttcttggatgcatagtttgcagaaattttctcccattttgtaggttgtctgttcactctgttgaaagtttattttgctgttcagaagctctttagtttaattagaacctatttgccaattttaatttctgttacaattgcttttgttgccttcatcatgaaatcttcgccaggtcctatatccagaatggtgttttctaggttatcttctagggtttttatagttttaggttttacatttaagtctttaattcattttgagttgatttttgtatacggtttaaggaggggggtccagtttcagtcttttgcatatggctagccagttatctcaggatcatttattgaataaggagtcctttctccattgcttgtgttcgtcaactttgagttactatgttttttttgttttttgttttgagacagagtcttgctctgttgcccaggctggagtaatgcagtggcgtgatctcaactcactgcaatctctgcctcctgggttcaagtgattctcctgcctcagcctcctgaatagctgagattacaggcacctgctactctacctggctaatttttgtatttttagtagagatggggtttcaccatgttggccaggctggtctcaatctcctgactttgggtgatctacccacctcggcctttcaaagtgctgggattacaggtgtgagccaccatgcccagccaatgtttgaaagggttaaaaaagaaatcaggccacgttacctgactataatgcaataaaattagaaattaacattaagaaagtagtcaaagccactttatcccacctggagatataaaaatatattcttaaatcttactttaaagataaaataaaatataaattataaacaatttagaaatgaataataagaattatacaaaattcaaatccctgtaattcagaacctgtgggaggcagtaaacaatggcacttagaagaagatttatagccttaaatgaattttctttttagaatacaagaaagattataaataagttaaaaataggataaagataaaagcagaatttaatgaaaatagaaaacaaaccaaaaagttgattggtaaaaaccaacagcaagatatttgaaaggacctgatatttggtagatttgatcaagttaaaaaggaagagtgtaccaataaactgcagtaggggaaaggcgagagacagttactagaaacagaatatggcagtgtgattagagattattatttataattttatattattaaatttgaaaacttagataaatagatgtttaaacactatgccatatttacttcccatgtggaagtgtaaatgcataaaaatatgcaagatacttttgaacaagaagaacaaggttgatcttattctttcagagaccaaaacataccacaaaaccacaataatgaaagcactgtgatattggcataagaatagaacataggccaggtgtggtggttcaccctgtaatcccagcactttgggaggttaaggcgggaggatcacttgaacccaggaatttgagatcagcctaagtatcatagtgagatccccatctctacaaaaaaaaggaaaaaaaattagctgggcttggtggtatatgcctataatctcagctacttgagaggctgaggtgggaggatctcttgagcccaggagttcgaggctgcagtgagctaggattgcaccactgtatactgccctgagtgacagagtgagaccccatgtcttaaaacaacaacaacaacaaaagatcaatgttaaagagtaggattaagaaacatacctatgtatgtatatgtgtgtgtgtatatataatatagataaatttttaaaaatatatacacctttgttggatgcatagtttacattatatatgagtgtattatataatgataaaatacaaaataatgcaaactgtaaaatttgtgtaaatttaataaaacacaaatcatgctaccatttctatgtatatgcacacatacagctgcatagataaaaaaagacaggatctaaaaataacttgaaagtcattacctgtggagagaactttagttttagctgtctttacacagagagagaatatattactatatcaatatattacttgcttaacttaaaagaaataaatagagcaagatacatttttaaactttcaattgagattttttttctggttttagtctaaataaagttaaccaggttatatatatacagattaagagaaccacaatacttttcagtcagttatcagctttgcaagtattgttgattattagctttcagtatccttagcttttagagtaaatttcctatttattcaaatgaagttgctttcagatttcttatgacttcttctataaaaagagttgatagtaactggccctcacatattaattcaatctatatttattgaggttctctgtgtgtactatgtgtgaatagataagactgcgagatcttttacagccttcactttatcttacccgtctttgtattcataacacctagcaattgcccagcttagagttagcacaccatttcaaattaaactcagacatagtctctgaattcattcattattttattcaactactagttgaattaaactcaaatatagtcattacgcttagagagtttatgatgtagcagaaaataatcaaatgattttgatacattatactaatgatagcttacatttattgaaaatgtactatgtgccaggcattacatatgttacctcgctctcagaaccatcccatgaagtaggaatgttgttattgccattttaggggtaaaaaaactgaggcttaataggaagaataagttcaagagatctattgtacaacatggtaactagttaataaacaatgtattgtattttgaaaatcactgagagagtagattttaattaagtgttctcaccacaaagaaattgtaagtatgtgaggtagcacacatgtaaattagctcgattgagccatttcacaatgtatgtacatacagtatgtccttatgaggttcattttatgaggtttcagttacccactgcagtctgaaaatattaaatggaaacttgtagaaataaacagtttctaagttttaagtagcatgccattctgagtaacatgatgcaatcttgtgccatggcgcatcatcccgcctgggacatgaatcatccctttgtccagcatatctgtgcagtacacggtacccactcctagtcacttaggagccaatttggttatcagatcaccttttgaggtataacagtgcttgtgttcagggaacccttattttgcttaataatgtccccagcgtgcgagagtagcgatgctggcaattccagcttgccaaagagaagatgtaaagtgcttcttttaagagaagaggtgaaagttcttgaccaaaaataaggggggaaaaaccatatgctgaggttgctaagatctgtggtaagaacgaatcatccatccatgaaaattgtgaacaaatgtgaatcttccatccgcgaattgttgttgtaattgttctattttattattagttattgataaattcttaactgtaacaactttataaattaaacttcattataggtatttacgtatgggaaaaagctgaatgtatagggttcgttaccatccacagtttcaggcatccactggggttttcagaatgtatctcctgtggataagggagggactactgtatttcaaaacatcatgttgtatacaataaatatgtacaaactgtatttgtcaattaaaagaaaaccctgagactaaaagggaggtggttgactacagttatacagacagttagtggcacagtgaggattttaaccaaagcagtttggctccagagcccatcctcttaactatctgtactgtgtggcatttttctaggctattctggtaagttctctccataaagtacataaagaaggggctgtaggagcccaaaagagagagcaagaaccccagggaaggcaccaataagtgtcattggaagtgtgttttgaaagatgaagtgtgtctgtggggatactaaggagtgtggcatgggtccaggaagtactgagtaattgagctggagcattaccagtgtggatgtgtgcaaaaggggaggaagggagcgaaggagagaacttcaggtgaagtaaattaatgcccaatgtacccttttttgctggaaatatttagtactcttttagattttttccttggtatatcagagaaattaaaaatggagtcctaatgcagcacagagagctaatatccatctgacgttgtgtgataatgggtccatcaggatataaaaccaccaaactgttaattcaaaattaatttgataaaagtaacagaacctgaacaaaattgattgtttgaattccctggatagttataagccattcagttggctttttgtggtaaggaaggataaattttagccctgagtttttcccaggaggccgataacaacctatgattccatgaaactttatcttaaccattctctcctagatcagggctccaaatctgattgtaagttgagatttctttgggtttttacaaagaagctttactgaattgtcagaacatagtcagttactcatttattattaggttgtactttttgcttttggctgcacatgttagaaatcagacacttgctgggaggcaagaattattactaccttatttataattagaaatcatgattgaaatggtagaagaaatgctttatttgcctacgcttaagtcaatactgtcaagaatgcatcttgatgtttcctgggaactcagttatctacaatttgaaactttatctgccatttcatagagacaaaaataactctcccaaaacatttggtgaaattattgttcatttatttcaaagtgactctaaaagttagtgcatattcttaaatttaccagcctttaatggtaaggtaaaatttaatgtcccattactcagttacaacaatcatcaagtcagctattcttgttttatttaatccttcacctccactattcacccacactgcttgattgttttgaagcaaatcccaggcatatctcatttctaaatatttcatgtgtatttataaaatattattgaccttttaaaaattataatacctttatcatacttttacaaattaggagtaataaatttccttaatgccaaaaaatgccttgttactgtttagtctcctggatttatatatattttttagcttgtttgaattaggatccaaatgcgatttataggaagttggttgatatgtctcttaagccacttttaatttaaagcccttcctttctgctacccctgctcgtgtactctgagatactgttggagaaacccagttgttatcccatatagtttcaaccttcattcgggatattgctgattgcatctaagtggtcttatttaatatgttccctgagtttcttataaattggtagttttatctagaacagaggtcctcaggaccgcttcatacttataaacattattgaggaccccagagggctttcgtttatactaatatttactgaattagaaattaaaactcaaaaaatgtttaaagaatttatttacttaaaaaaaaagctaattatacattaatgtagtttttttcaatgaaaaatgaccattttcccaaaacaaaaacaaatgagtaagaaaaatagcattgtttacatttttcaaattttttggcttagacagatagatgatcctatctgttttgcattcagtctgttgtaatacattgttctgtttgaagtataggaagaaagtctagcctagcaaaaagaggtgtagttgaaaaagacagaactattgtaatagctgtttaagataactgtggatagtctttgaccctataccaaaactcaacaagtagtggtttcttataggttagttgcaatgtagaatataaaactaaattcatgaaattttcttactctgtatattaaaattcattgatgttttaaaattttgagtggaacttttactcacacatgattttgtaacatcacgcattgggcatttggaagatgttggttcattcagttacatggatcttctaaatgttggcacatttcattaaacaatataaaaaaaccccacattccttgaagttatgaccagtctcatcagaagagtagctaagtgtagggaagttgtcaagctcacagtggtagattcaagttttccagaatacttattttcatttgaaggtttgaattttatcatcagctacaacactcttagttgttttcctttgagtgacagactcacttttttcatttctgagaaaatgtctgccagatacccaagtctgaatactcacagtttgtcatttttcatgtaaaatggtgctctgtggaaaaagcagctggttgagcttgcagctcaattgcacaagtgctttgcttcaaaatgaccattgtatttcagttaaaacagaagtgctatatgcggacttcccatttcatcatagatactattaaaaagacatgaacttttttactacttcatcaaggacattcttaaggatttttaaaaaactgtagccagtgactgtaaagaatgcaataactgctgacactatttggtgccactttttggtttctactgaggctaacagttttagcccccactgcttttgtgtaatcagtacagatgtcaacacagtagaaaagtcaaatagtgtcttaagattaatatgaaaatagtttggtcttatagagtcccctaagagtgtgtcagggatcttccagggatctgcaagccagactttgagaattgctgatctagaagcttgatcagaatcaggttcgatttttttttttttttttggcaagggtatttcataggtggtatgtatacttccatcagaaggttcataatatctggatatatggtcatctctctttttccgttgttagaaaccagtgaaggtcattgtctggatgccatttcattagaggttacaaagtggtgacatttgatcatttcttctccatttaccaattgaagtaaagaagcatttcattatttagataatctcaggtacaatgtatacagaaaagacagaatatgcacttgattttttgatttttattataattttcaaaataatgtattggttccctggcattctccaaagatataaccagggattttttttgtatcataaattcgtggatttaaaaatatttgatctgtttcaatcctttcatctatttcttatgttcaaatggttccatcttgatataaccccagtagttacttttaaatgttttattgaggtatgctttatatactccctggtagtttgtgagagcatccttgctttctagtatgatgagatgtgagatgttccaggctcatcttgtccatgtcttgctccaaacctggaaacagaccttttttttttttttaaggaactcaggtttttaaaatgggaaatggtaattagagaccacagtctgggtgcaagttgtgctcattgcagttaggtcatttttttctaagccttttcaatgtatgaatccaggaaatgtgtttattacaaactcatgcgttcttatgctatttccagtgtagattgaatactactagttttttccttaaccactttcatcccacatctgtaatcctttcccccatgccaaatatcttcccagcaattctaatataattactcatttgtttttcaattcacaataaatgtcagcctcggaataataatgccagtacttctgacaacaatactgaaaacagttaaagatttgtgttgcagcttgttgtccttagggacatcccatatagatgtacaatgaaattattatatgttaaagctactgggaataatttctacgtggttatgccacaaacttaattggccaataggtttttttgtttcattttgttttttgtttgaggtattgctttttattgttttgctttataattatataaactatatggttccaaggggcaagtctacaaaacaaagttgttcagatttagtttctattcctatctcctctgtttcctcctttttttaatgtttgggagatatacacaagacacatgtatgcatgcatgcatgcacgcacagacaaatacatgtatgtttgtactaccattctgagataacagtagtgtcctgtccatacttttctctgtttgttttttgttaattatatatcctagaaattactccatagccatacatagagatagtcctcattcttttttcctatgcttagtattctgttgtgaggatgtattgtagtttattcagccagtcctctgatgatacacatttaggttgtttgcaacagtttttaagttgattgcttcataaacctattcataaatagggaatgcaattttttatgattgttttggttttttaggttcatgctttgtcagttttgagaagcaagttacatgttttaagcgtgtttagcttttttttttttttaaacagcaaggagtggatttattcagaggtctccctctgccacattttagtgctgtttgtataaagcagcccctaagactctagtcataacatcacgtgtcacaggaagagtgagtaatcaatctcctggcaaacattgtttgttagcctgccgcaggcattaaaatgttgccaggtgttaacaacctggaggcctggaattcctaattgctgtaatcagaacctgaagtttttaaagtttgaatctcattacaaccaaagccagatttggttcagttactttaatttttctataatttgaagtcagaaaagaaaaagaaaaacaactgtaacttcagtgttgtttattattcatcaagaaggtttcaatggctgaaatttaaaatgtaaattagctattactctagaaagcacagtttttagttttcagctgagatgaatgtatttttcttattcctggatctatagccacgcttttgaattatgatctcattcacttagacacatatttttcactcttcttttgagctgttgaagatattttcttcagtctttcttttcagctttacctcctgtttttttttctcacacgaactcttgacaattcagtaatccttattcctgggacatgaaatgttgagaagacaaaggagatttatgcaagttttcccactccatccaaagaaagggtctctattagagctcttgaaagtgatatttgcttatgtagcccagtgcctctgaaagaaaaaacatgatgcagaacttttctcattatctaaggtgtgttcctggtgtcatttccctctcccaacaggaccacttttacctaatacaaatctggatcctccactactcaagtgaaatacaacgcaattagcatcttttgtctttgataacacacctactccaagcaccagtaatgctggaatggaaagcatgtttcatttcctttcttcatttctctgttggagtttgatgctgatattactgagatttctaatggacagtgtagggaggagaaggctgattgatggtaatttattgtactgctactgagaaaaaaacacaactcagggtattggttgttcgatacatccagattttttgactgaaaatgttagattttactttttcttttttaaaaatttccaacttttaagttcaggggcacatgtgcaggatgtgctggttttttacataggtaaatgtgtgccatgttggtttatggcacagatcatgccatcacttaggtattaagcccagcatccattagctattcttcctgatgctctccctcctcccaagcccccaccctctgacaggccccagtgtgtgttgttccccaccatgtgtccatgtgttcttatcattcagctcccacttataagtgagaacatgcagcatttttttttctgttccgtgttagtttgctaaggataatcacctccagctccatccatatccctgtgaaggacatgatctccttcctttttatggctgcataatattccatggtatatatataccacatgttctttatccagtctatcattgatgaacatttaggttgttcattacagcactattcacaatagcaaagattttacatttgtttagaaggcttgataaagttgcagttgtgtaccaagtgtaccaaagtgactgttcttttagtgaagaagcagtagatttggtagttaagatcattggaatcaggctttcagcgttcaaatcctgacttcaccatttgctgagtagctgtgggccacttacctctcctctctgagcttcattgtcctcatctgtaaaatgaagtaatactagaacccataggatacattttgaacctatatgagagttaaatggagtaatgcacatcaggggcctgcaatataatacagattgagtatcccaaacctgaaatcctgaaatgctctaaaatttgaaacttttgaacagtcaaagaaagtgctcattggagcatttcaaatttcatatttttggattagagatggtcaacaggtaagtataatgcaaatatttcaaaatcctccaaaatccaaagtttaaaacacttctggtcccaaacattttggttaagggatacttcacctgtagtcacttcataaatgtcagcttctcctccctccttccactttcccctcctttcttgaaacattgtccatggagtaaatttcactacctaaacttttcccccagtgatttgccattgccttctgttataaaatcagagatacattcccaaagaatacttgctcccagagggactgatctaaaactactctaaaacaaaggaattaaaactattactgcttggaaattgattaccaaagtgatcataggtatcaattttagaacttcctaatgctttcttcctttcttttccttacatctctatacaataatacagtgtttctttctacccacctctcaaatcatgaactgttgaggttaacggaaattttcaaatcttgaagctctgaaactacttcccttacagtaacacacttctaccaatagatgccgccctttcacttcttgagtgcacaatctcctgtgtggcatttgcttaaggcagagcttgctggctatgtaaaatgaatgataaaattattgaaccaggccgggtgaatgataaaattaccgaaccagtggctcatgcctataatcccagctttttgggaggctgaggttgcaggatcgcttgagcccaggagttcaaggccagtctgggcaacatagtgagaccccatctctacaaaaaataaaagcacattttaaaaagccaggtagggtggcatgtgcctgtggtcccagctactcaggtggttgaggtgggaggcttgcttgaacccgggagtatatggtttgcagtgagccgtgattgtgccactacactccagtctgggcaacagagcaagatcgtgtctcaaaaaaaagaaaaaagttactgaatcactttagaaatttgacattgtgtgaagtgagtttgtttgaaaatagggaaaacttgtaacacagaccagtagaatgaacattacattacataagaagaagggtgaatggcccaggctttagctgggaccttgggtgagtcaccctcctctttgaattttagtttgtgatctgtaaaaattaaacataatagtacctatcctgcttttcccacagagttggagaaaggatcaaatgaaatatacattgggttatttgaactaagtttactttcaaaactttggtagaattttattagccaagaattataaggccgttgatgtttattttcggttcattgtgtattaagtattatcacttatttttatttcacattttattttactattataaaaaaattaactctttgaatgatgacaaataattcagaagtgaggaagacaaaggagcagttaagcctggatttctggtatgactccgtttgctgatgatagtaacattatcactttagatctaggtagcatttaatatagttaaagatgcattcatagtttgttcttttgtttggcaatgcttacagtgtttctgtgaggtagcagggtggggtttcttatcctcttatagtttgaggaactggagcccagagacattttacaaaggcatctttcctacttggtgccagaatcaggtctggaacccagacccctaagtggcttcctgtctgcgttaattcataagtgtgtgtgttttctcacatgaaaacaaaaacaaaaactatgcttacatattaaatacccaatgttataaaccaggaaaaagaatcttctttcaaataacatgtgatagggactacagtaaccaggaagaatgatttcaggtttattgcatcttcctgggaatttcgtgacattagaggagtatttattattaactcacagtgttttttttcatgcttattgagaacacaatgcagattgacaagctttgtatttcattaattgtttatgcaaacaattcttattggagcaatttaatttgtactttcttttgctgttctttcttatttactttctaattatgggttgtacagtaattttgctattgtcagaaagtgtcttttttttttgtttgttcgtttgtttttttgagaaggagtctcgctctgtcgcccaggctggagtgcagtggcccaatctcggctcactgcaacctctgcctcccgggttcaaatgattctcctgcctcagcctgctgagtagctgacattacaggtgcatgccaccatgcctggctaatttttgtatttttagtagagatggggtttcaccatgttggccgggccagtcacaaactcctgacctcaggtgatccgcctgcctccgcctcccaaagtgctgggattataggcctgagccaccgcacctagccagaaaatgtcattctaactaaaaaggcattattattttaagaacatttttggttttcgccaggtgcaatcccagccctttgggaggccaaggcaggaggattgcttgaggtcaggagttcatgactagcttgggctacatagcaataccctgtatctacaaaaaaaaaaaaaagaaaaattggctaagtgtggtggtgcgtacctgtagtcccagctactcaggaggctgaggcagaaggatcgtttgagcccaggaagttgaggctgcagcaagccatgactgtggcactgcactgtagcctgggtaacagaatgagaccctatctcaaaactaaaaggaaaaaaaaaaaaaagcaaatataacctctgaaaacaaaggtatctattgtggaggaatcttaatggatacaggaaatatttgatatattttctggttatatctctgtcacagtgtgcttgtcagtctcattcaggcacttgttcctgaatttttcttctcttctactctgttatctattgtctaatcagtatgggcttttctgctaatttgcttttctttttttttttaaatttatttatttattttttttccgagatgaagccttgctctgtcacctaggctggagtgcagtggcgtgatctcggctcactgcaacctccgcctcctggattcaagcaattctcctgcctcagcctcctgagtagctgggattacaggcacctgccaccacatctggctaatttttgtatttttagtagagacagggtttcaccatgttggccaggctggtcttgaactcctgacctcgtgatctgcccgcctcggcctcccaaagtgctgggattacaggtgtgagctaccacgcccagcctaatttgcttttcttactccagtgttagataatgaatatttttagtaatcttcatattggttgctcattatcttgtctaattttaaattttattggcagacacacttggtctcttaagactaactacattttggattttgacaaggaaatgatgaaaatagcagttattgaatgcttgttgtgtgttaggtccctgtaaatgttttataccatcttcttttcataatatcctcacatggtagatcttatagatcttattcccacttatttgacagagaggctttgaggcgctaggtgacaagagatgctaggtgacctgtcccacccttggtgcatgattaataaaagatagaccattatttttctcagaataacgcacgtttgtttgtgtgagaatggttatatatgtgccgatggtaaacattcatctaattcagatgctgcatcttttctttctctaacatgtgcagcccttagcgaattgccatagcatgcaggtgctcagaatgtgttatttgattatgttatttgggcccattgtgcactctttggaaatctttttaaatttcttcagattttctttttgtaatatccattcatctatgtgtataggaatatgttaattggactataatttcatagatgtggaatttagatttcttccctgcttctttggtaaaactgtagtaaaaaacattgattggaaatacagtgttgggaattcccttgatcgaattggataaagcataaagcatttagcaaagtgcctggcattcctaatctattattaatatgtgggttccttttagagtgatggcttatttatagtgaagaagagcagtgggttgggaatcaggtctcagctctgactgtaactagctttgtgtccttaagtaagccacctaacctttctgggactctgtttctttgtctgctaaaggtaagattaagccttcaagagccctcaaactctcttggtctttgtttgccaatttaaaaaatgcagctaatgcgtctctctcatagggatcatgtgagcctaaaataaagagcttgtgtaaagtgtgtaaaagatgctcagtatatataaggttcttttcctgttcttttaaaagcagagaaatgcttaggacacccaggacgccaacatgagcatagaaggcagtctgatatactgaccaagagcagatagacttggatccattgctggtttcattatttatgggaccagtaactctaggcttctcacccaacctaaaatgaagatactaatcatatttacttctgagttattgagaagattaatttaaaaatgcttttaaagtgcttagcagagtatctgacacagagtaggcattcagtaaattttatttacatgtgtaacacttagggtgggagacatggatgaactactggaaaagggaaagatactgaggtgggctgccctaaaaaaggaaggtaagaggaagacctacacttatttcacacttttgttgcaggccctgctagttcacacattgtttgctttgtgattttttttttttgagacggagtgttgctctgttgcccaggctggagtgcagtggcgtggtcttggctcactgcaacctctgcctcctgcgttcaggtggttctcctgcctcagcctcccgccaccatgcccggctaatttttgtatttttagtagagacggggtttcaccatgttggccaggctggcctcgaactcctgacctcaggtgatccatccgcctcggcctcccaaagtgctggaattacaggcgtgagccaccatgcccagccatgatatttattttatacctaagatgagcttaattctgttatgactttcttgttcctagggtgagcttaattctgttatgactttcttgttcctagggtttaaatatcaaggatactcactaaaacactgatagaccttttgtgttttctctgattgcttcccttctgtgcctgcctggaggctataggtcctggacagttcccacattgatgttttttttttcaaaacagttttttcctgatggtacatttgttaatgtaaaatagctcaagtaaatgtatgtgcgtatgtatgaaagagacagagagagacagagagagctgtatgggatccatcagctgccgagggtaccctttcatcaagcagagttcacattgcagagcattggatcagagggtggccagcagctggagggagagcaaacttgaatctactttatagacccactagtcacttccatttgccctttacttaggagaaaatacacagcaaaaactgttctttagacatggatgcatctagtttaataaatcttaatgtagtgctattaaaaatgaggtaaagtcaggaaattttctaccccctcccaagtgctcttattcctagatatgcaggaccaagcataaagttattttcacacattgggaagaaatgttccattccaatttcaagtggaggttttccacttttggaagtgctgctgagactgcaattataaactacaactattcttttaaaacagttcctgggatgaattaagatcttgcagtaaaaataccatatacaatctgtcacattatctgtggaactcttccctttgccagcttggtcagtgagggtaacagctgcccagagttcattgctaaacggatgtttaacaatggtactgtgaattcagcacttcatattagaataatgcttgagttcctggtattcggttaatggagttttacgtacagtgatacagaaaatatgtgatgcacaggatttcagctttttaagaattctcaccacttctcctcccatctcaattttgttgttgtggaaaatgaaaatcccacaggaaagccaagtgtagtcctcattccctgacttctggctttgtactccatcactttccacttccttcccctcccctctctacactgttcacctgggcctaaacgtctgaatgactgcagcctcaaggaaagcttcaagttagactagatgacctttaaggttttgttaatcctgagaatccgtttggccacatcaatgagctcctttgtatctactcaaatgtgatagaacagacgagcattcagagtaaggggatcttcctaggctggctgcagagagaacagtcagcagtgctcgtgccatggctacagattacacatctcactctgggggtgtgtggggactgggaaagggggagccagtttggcctgtggcacatgtaatttttatactttgaactactgaaatgggtctgagttctccagctcttcacagaccccatcacttcctgtttttgttttatgagcagactgttgagtttatttctgttgtctttgccagtctctcaaaacatttgtgtttgtgatctctgatttaaccagtctccagctgatggtcatttaggtagccttcagctttttaatattaataaatattgctttaataacatctttgcatggtacgcccttagaattaattcctgcagtagaattattgggtcaaactgttcacaaatttgaaattttgatacatattgttaaatttccctatcgtttttggtatgtgaattgttgctttatattatttactgaattttccatggaattcttattttctttattgattttaaagacttcttcagctatcaagtcaggttatgaaccttttaacatatgtggtaaagatattctgctagaatatcttttaaagctttgtatatggtatctaacttcagacatttaaatttttatatattttgatttattagctttttcttgtggtttctggaattttatgtcatctttgggaaagtttttcacattctaagattacaaaaatattaacccttactttgttttagaatgttttattattttttctttctcaatatttaatctatcatgtatttgtcttggtgttaagagtaaggtagcaatcgagctttatatttttctaacaaccaagggtttaaaaaatacataattaatttagaattaccaaatcttaatagcttatagtacctaaaagtggcttgtttttacagatagaaactttccacttcaaactctgagttttaatgtttttcggcttttaaaacctctagaaagaaactgtgaacagaacaccgtattggttttggcattaaccttaatgcatctcaaataggctgattctacagaatttgatccaaagtacttctatgtcttgatcctttttttgccaagcaaaattgattgtttctaaccaaaaggcctttagtgctagactgaaagaaaagtaaggtggtccttctgtgctggttgtattttatataatttggcatcaagtacaatgctttttatttttctctttagtttctttcttttctctagcctttgatggtccaggcctcttgttgctagggggctttttgggagacaaattcaaatccttactgtctagctcattgttattgtatcttttagtgagttccttttttcatggtagttcaataagtggttaccaggggtctttctttgacagttattactagcttctcttgtatagtgggatttagctgtgggttgatttgttgtgctggtatgttttcaactgcagcgatgcattgctctatcacatggattctttttatagcttcattagaggtgttttagttcctcttttgaatatttatctgagtatcttagtaccttggcagtcacactatcctaaattattatagtgccttctaaagtagattttgtcattgaggcttatgtttaggtcaggcttgcaggcagggagacagattatgccattgtggttgagaggcatatagtggttaaaaccactggagttattctgttagggctcatagcctatcttctccacctattatgccacctgtctaacccttgattgtcttatctgtcaaacatggtaaagtcatacctctttcatagggctgtcgtgagtatcaaatgagatgcaggttgcgtaatcccaaatccaaaaatccaaaatccaaaacacttctggtcccaggcatcttggataagggatactaaacctgtaatgcacgtaaagcacctttaggacaatggtccttactgctggcctgcaataagcacttaataaatgttattattttcttcttttttggtgttggtttgctcttctataatgttacaatgctattttgttaaccttctagttgtaaaaacacactcattatagaaagtttagagactgaagaaaagcttaaagaagaaaatgtctcttacaactcttccaccccccccagcaataataattacattttaacatttccttccagttttttaatacttagatattattttacacagctgagatcattctgcatgcataataaatcttgattttttttcacttaacatatcttaaacattttctcatatcattaaaaacacttgtgaaatcatttttaagggtcacatagtagcccatcacattacattcttttgattgatttaatcatcctctttttacttggcatttaacatttggggcttttttggttggagttgggttgttttcaggtcgttctaatatattaagccaggcttttttcttgtcaacaggaggtttggggattgagtctttgtgattgtttttattgttgcatttttttgcctgttgagtgtgtgaattaagctggggttttaaccatcagcacctgcgctctcagactcttgccaccacctttctggacaatctccatgctctgctttttaaactttttctgatgagtttcttttcttctgtgctagaagaaagatgaatggagactatgtttggtgtttaggtttctgacccggcagtgccatgtgaatgcccagtagctagccaaggtcaacagcactgcctgttaatggctttttactgaagtagtcctgtcgagcagtttctggtgagaagactatcctaaattgttcttgacagggtacactatttttgtttcaacttcttatttttcctgtaaagcttggtttaaagtatgttgagactgaatttatttgtgctttggaatataatgagattttgtgctcttttctttcagaaaactagccaagaacagcagtctggaaaagacatatgtatccaaaattgccagggaaacctgctgtgtagatacgctttctgagaaaccacatggtaaatgaatgtcatctttgtctcagaaccacagtagcctggttctgctggtggatcgtgctagctgatttgagctgggtttttaactcagttattgaaatggctttgagagcaggacttaaatgcctgcggtttttgacctcaagaggttgcttaaaacagtatcagcctgtgtgagcctgagactgtttttcatttcctttgtttggttcggagactgcttgatccatggctgcttggcaggcttcttctttagcgttcattcttgtggccatttattctctgatattaaactacaggataattttaatctcaactacatggtgagaaaaagagctgagtccagactggctcagaaatggagcctaagaactgcaataagtatcctagcaccttaggccctaggaaggactgttccatagttaacttctgtgtggcttcactgtaagcacaggtgacagatgggcatgtcttgaattcctagaagccattgtctctctcaatcatctgttccaacactgtatcagagaatgataaactttcagaattgaaaagggtcttaaaggacatattttccagctcttgctatatttccaacaagaggcatcatctcacatttgcttgactacctgcagtcatttctgagaagagggaattccacaagttggaagtagttcaaatcattgctcaaagctgtgtgtaaagatagtagtttttttttgttttttgttttttttttcagccaaaatttgtccccagggaacctctatccatgaaattttgattacttctcacaggaactttagcaaaagttagttgggattgtctggattttccgttttgcagatagagaaagccaccatctctttcccctaactacttagtactatggtaacttgggtttaggaaaatttgccagttcattgttaccaaggcaagtgactaaatcgtgggttctctgtatgctaatgctgccccgcatataggctttactgctgtccgtgcttcattctctctctgtttagctgagaaaatgagtgtgaaagcacttagccaatagtagtagatgttgggtgacatttcattaaaagtgcagactcctggccaggtgcggggctcacatctgtaatcctagcactttgagaggccaaagcgggaggatccctcgagcccaggagtttgagaccagcctgaccaatgtagctagaccttgtctctacaaaaaattaaaaaattagccaggcatggtggtgcccacctgtagtcctgctactcaagaggctgaggcaggaggatcacttgaacccggagtttgaggctgcagtaagctatgattgcaccactgcactctagcctgggcaacagtgggacaccctatcttttttttttttttttttcaaaaaaaaaaaaaaaggaaaaagtacagaccccagagtcagacagaacctgattcaattttgatttcaaccacttgcgggctgtgttaacctcaatggattatataattcttcaaacctcaaattccccatctgtagcactgggttaataattatagctgtaagatttaatgaagagcaaatgagattaatacatataaaatacttaatgtatggctgctaataatgaacagttaatgcttaaaaaattctggcttttattattgctattgttactattcctgtaatcactgtccaacaaggtccctgaatctgccctctcattaaggcaatacaggcagagcttaaccttctctcccacctgtccttgtgatttcttctctccataggactacccttggtattcattttcacctgatttaccaagaatagcaatataagcatcaaaagaaggggtggggatgggcatgtacacaatttctctggcccctggatatccctgcttctcttacatggggaggtttcaggagtgaccttgttactctgccgtgttgtcagaactggaggttgggcgttaacttattttttctcattttcctgcctttagggaaaacacgtatattcagaaatatcatggttgtctctattttcagagatggtttcatcctctgtggctctgtcatttgagtatgtgtttttaacaatctactcattccactttgtccttgtggtctagatttcttagtagtcagttttgtttggtttcactccagatgtaggtctctgccgcttcccaagacatcttaatttcatgcacatttaaaaatttattggcatcaagtttcagattttaaaatttgcagtatctgtatttatagcttgcttttcattcctgttatttgtttcttcttttttttccggggggtggggatcagtcttatcaaagtgtaattttttttttaagcccaaaccagcttttggttttgttgatccttgctactgcacattaacttttgaattcattaatttatgttcttacatcattttcttctttctgctttctatgggtttatttctcttttcttcacttggacaattcagcttactaatttttaattatctttcttttctttttctttctttctttcttttttttttgttttctttttccccgagacggagtcttgcactgttgcccaggctggagtgcagtggcatgatcttggctcactgcaatctttgcctcccaggttcaagcaattctcctgtctcagcctcccgagtagctgggactagaggtgcacaccaccatgcctggctaatttttgtatttttaggagagacggggtttcaccatgttggccaggctggtctggaactcctgacctcatgatctgcctgcctcggcctcttaaagtgttgggattaccagcgtgagcccccgcgccgggcccaattatctttcttttctaacatacatttaaggctgtaaaatttcctttaaatactatttcaactacctgccacaattttttgctatgtaatatttttgtaaagtcagatttgttgaggtttaatttatatgctatagaacatgctccttttaagtgtacagttggatgagttttaatagaaatatacagttgtataaataccaccataatcaagctatagaacatttctaatatcccatcaagttcccttatgccctgttttttgtccctaaagttttgtcttttctgggatgtcagatgaatggaattgtgcagtatatagccttttgtgtttggcctcattcacttagcatactgttctgagatttgttcatttgttgcatatgtctggagtttgttcctttttattgctgagtagtttccattgtatggatattaccagaatttatctgttcactactactttattttcagtgggagaaaatgagagtattttaattctgcatttggactgtaaatatcatccagactcttctggattggaaagtatcttggcatttttcaaatacaaatatttatttaggttttatcattttgaaagttcttccattagtgggcaaacatgagctcatgtgtattcacttgcacgcttcctcctgtagcagtctgggttcagagaggagatagaaaccacacagtagattaaagaggggaaatttaatataataagtattacctatgataaaagagtaactatcagatatgaagaaactctgtagcgttccctaaggctgagggcgtatatccaaggaaggacaaactgccagggcttcagacttcattggagaagatgtggttcagcccatggaatcacagaggagtttgctggtttgacaagactggagctgatccaaagtctctgggcaagccgtcgtttaccttctggagtgctggcagagagcaggccatccagtgggttactggccatccggtgggtagcagggtgtgggccctggctgggccaggaggcctttagaacacaagagccatgtggaggctttagtggccatgtcagctgagctcccaaaacgttaggataggctgagtctgcaaggtcacagaaagaccacgttctaggctgtcgctgggccacagtgtcgatggtcctcacacccacattgccatctcccatgctggacacttaggacagcctcttcctcccagtgctctactgagaaaacttcacagcacacgttcttcagagaaatgattatcacagaatgcatctagaagggtgcacttggatcttagaggtaacacactatccctattcttttaaaaagaagtgctatcaagtcaagagcagtaataactatatgcttgtgttattaacaatcagacccttcatgaggggaaaagagtttatgaaaattagaacttacgtagttttaagtaacaaagatatgtttatagacaaatagaactataccttcccatgggacctgtgttatatactaatcatgatattgtccctattctcccctctcccagtcattggaatcatagattccaagttgtaagtcagaccccagattggaagcactttctttgttcaagatgtttgctcattatagaaaacatttaggaagcacattttaaagaacggttttataccagagaagctaagtgtttttaactctgagcctagatgagcttactgctaggagtatagtgtttaaacctttcaaaatgaaaaactaggacacatggtctttacaaaatttttttctggtttaggaatttatacacatttgagaagtattaccatggcataaattaattcacatttgattataccaattaaacagttgccgaaaagaataaaagactatcctaaaatatttaggctatatacatactaatgcttttacagaataaggattaaacaaacctatcttttttagagtcttcaaccagaaaaatgaacaaatgataaaaacttatatttagcagtttgaaggtcacacacacacacacacacacacacacacacacacccctacccctatctagacctattttatgtttttgacactgtagagagttcaagtcctaagactttatggccattataaaaagattctgacatgctttgtggaattcttgtctgcttttgttgcagatttttttttttctttcaaaggattgcttgagagggtatttcttttttgggtatttaggttgtgaatctcacccttcattacatgggagtacccagcagtaaggcttacagagtgttatatactttccagaaactgagtgctatgtacttgcaatcttttccacgctaagaaatccccaattttaaaacttcaacctgcaaagtagcttacttagggaatttctatttgtattcttgacaagttttctgtaagcattcttttttcttttatgtgtttaaaattggatcctatttagtctgaagatgccttttaagactgcatctattaaataaagtgagatcaatttgcattttagctttcaaattttgctggggattctttgggctttttttatttggcaggaagagagagaagcagcttggcctttttgctatctcggaaatttccagcccaagaaagcatacagagacatagctcgcagggtttcttatgtgattagctagctcttttcctgaattattaagctgcattaaaacagtagctcggtgcagttggtgttttaggttttcataccttctgaaagattaatattcctacaagaatgaggttatttttgatgcctccctttagtgctttcaaacatcaagagcctcgcattcttgtactctaccttctgtagacatttacaattattctaggaggtgtaatgggtgtttactaacttcctgaaagtgtttctctcacagattggcttccttaagtgtgaaatttatacaccaatttaaaactacagtgtcccccttgtcaatgggggaatatgttccaagaccccccactggacacctgaaactgtagatagtactgaaccccattgccatcagtcagaacgtttctgttcatgtctttcacccacaaatttaatcccttttctatcttaaccaagcgcttatcacacaactgtggttgaaacttttgctccttgaggtatgacagcaaaactagcatgtatttctttttccttcttcacagtatcatgggtagaagattcattcttactgtaatcttagcagccttagtgtatgattttttgttgttagccaacaatgttcatcttttcacttaaaggaagcacatcatggtttctcttcggcatatgtgaattgccagcatcactactcttgcattttgggtctattattaagtgaaataagggttccctgaacacaaatactgtgataccaattctgcaacagtccatttgataaccagggtgactactgagtgactgaggggtggatagtgtgtatagcatggttatgctggacaaagggatgattcacatcccaagcgggatagagcaggacagcgcaggatttcatcatgcgtctcagaatggcacacagttaaaacttaggaattgattatttctggaagtttccatttaatattttcagactttggttgactgtgggtaactgaaactacagataagggggaatataatatactcttaaaatagaatttttcttaaagagcaatcataagcaaccaggactagagaatttttttcatttttttccttgtaattttattgcaagtaggatactgaattagttgcttattttgattttggtatgcatggatcaattttgagtaattgatacaactttatttaatgaacttaaattatcctcttaggcttatgtattgattacatactttcaaagctgaaatgcttgagagaacccagtaaaaagtcagtatcattttcaaacaaaggcttaaagattaaggatctatttctttattaaatatttattaagaattattttttgctggcctgctctctgaaaatatattagatatagtctttaatctcaaataggtcctactttagtaaaagaaaaagatacaggattgagagaggagttggagcttgtgctgagctggaaggttgaatgggcagccccctaagcagaagacagaattagatccagcagaagcttggaggtgtaaaaaagcatggcacctgaaggaattgggagttgttgttagtatttctgactaatgagctcataagtcttttcgtttatttaacctaatttgattagttctctgtatctcaaatgtgttacttgatataaccaaacttgcatttcatttttaaaagttaaaattcagacctttccctgatttagaatgaccccctcttctctgcactataaatgtgtgacgagataaagttttttttcccatagactctgaccacagggattcttccatctgtcaattcctatagcacatgttgccttgacacacagttggccaggctttacagtcagacacgctaaggttcctatcctaattcaaccacttacaacctctgggaccagaggcaaatgcctatatctctctaagcctccagtgtctgcgtctgtaagatgaggggtaagagcacttatttcttggactgttgtgaggattactcgagataatgcatgtaaggtgctgagcacaatgtccagcacatagaactcaattaaaagtatctctaattaatgttagtgatcattagccctcactaataccctagactgtagcttgttttcatgacttccctacctcttttctctccacaactagcgtgaagggagcatgccatatactttttttgtcccatacccactcttactcacccatactcctcgatccttacatgggttctgacacagagtgggtactggctacatttttaaaaagatgtaatgctagatatcagcaagtaaaccttgggggataggaaagtttctgatgggttcttgctgtggagaatcaaggtcaaaatgatagggaaaaaaatctgtgtttggtcaaaactgtattacctttggtcaaaggctgttctaaaactcacagaacaaaaacaaaacaaaacaaaacaggtgctttgtgaattccatagcaagtcgtaaaggctcatgccagaatagagttggaataaattctaagcatgcaaaatactactttaagaattttgtcctgtaaatttgagaatgttttttaattacggtagctcccaaaccttaactatggttttgctttccatggcttcagttacccacaaccaccgaatattaaatagaaaattccagaaataaacaattcatgaattttaaattatgcgtcatcctgagtagtatgaggaaaccttgtgccatcctgctccatcctgcctgggacatgaatcattgctctgttcagcatatccactcggttgcacccattagtcacttagtaggcatcttggttatcataaagactgttgtggtattggtattacagtgcttctgtttaacccttttgttttattttagtatggaaatttttttttttttttttacttttaggttcaggggtacatgtgcagttttttacataggtaaactgcatgtctctgaggtttgatgtagattatttcatcaccaagtaattagcatagtacccaataggtgatttattgatcttttcccttctcccactctccaccctccagtaatcctcagtgtctattgttcacctgtatgtactcatgtttttgttgtttagataagtgagaacatgcagtatttgtttttcttttcttttcttcttcttcttctttttttttttttttttttttgagatggagtcttgctctgtctgtcgcccacgctggagtgcagtggggcgatctcagctcactgcaacccccgtctcttgagttcaagcaattctcctgcttcagcctcctaagtagctgggattacaggcatgtgccaccacacccagctaatttttgtatttttagtagaaacagggtttcatcatgttggccaccctggtctgaaattcctgacctcaaatgatcctcccaccttggcttcccaaagtgctgggattacaggtgtgagccaccgtgcctggcctcagtatttgtttttctgttcctgtgttagtttgcttaagataatggcctccaactccatccatgttgctgcagaggacatgatcttgttcttttttatggctacacagcattccatggtgtatatggaccatattttctttatccagtctaccgttgatgagcatttaggttaatgccatgtctttgctattgtgaatagtgctgtgatgaacattattgtgcatgtgtcttcatgatttatattcctttaggcatatacccagcaatgggattgctgggccaaatggtaatgctgttttaagttctttgaggaatcaccacgctgctttctgcaatagctgaactaatttacattcccaccagcagtgtgtaagcattctcttttctccacaacctcgccagcatctgttattttttgactttttagtaatagcaaaaaattctgactgatgtgagacgataatcttactgtggggtttttttttgttttgttttgagacggagtctcgctttgtcgcccaggctggagtgcccagctttgtcgcccaggctggagcgcgatcttggctcactgcaagctccgcctcccgggttcacgccattccccggcctcagcctcccaagtagctgggactacaggcgcccaccaccacgcccggctattttttttttttttttttttgtatttttagtagagacagggtttcaccatgttagccagaacggtctcaatctcctgacctcgtgatccgcccgcctcggcctcccaaagtgctgggattacaggtgtgagccaccgcacccggccttttttttttttttttttttttttttttttggacacagggtcttgcctgtgtcactcaggctggagtgcggtggtgtgatcatggctcactgcagcctcgacctcctgggctcagttgatccacccatctcagcctcctgagtagctgggactacagggatgtgccactacacctggctaattgtttttgtatttttttgtagagatggggtttcaccatgtttcccaggctggtctcaaactactaggctcaagtgatccgcccacctcagcctcccaaagtgtgattacaggtgtgagccactgcacctggcctcattgtggttttcatttgcatttctctaatgattaatgatgttgagcactttgaatatgcttgttggccacatgtacattttcttttgaaaagtgtctgttcatgtcctctgcccactttttaacaggaaggtttgttttttgcttataaattcgtttaagttccttgtggattctggatattagatctttgttggatgcatagtttgcaaatatttcctcccattctgtaagttgtctgtttactcccttgatagtttacctcttgctgtgcagaagctctttagtttaatttggtttcatttgttgatttttgtttttgttgcagttgcttttggtgtcttcgtcatgaaatctttgccaggtcctatgtccagagtggtatttcctaggttatcttccatggtttttatagttttagattttacttttaagtctttaatttatctcaacttgatttttgtgtatgatataaggaaggggggggtccagtgtttttatttatttatttatttatttttgagacggagtctcgctctgtcacccaggctggagtgcagtggtgtgatctcggctcactgcaagctccacctcccgggttcacgccattcttctgcctcagcctcccgagtagctgggaatacaggcgcccgccactatgcccggctaattttttgtatgttttaggagagacggggtttcactgtgttagccaggatggtctcgatctcttgacctcgtgatctgcccacctcagcctcccaaagtgctgggattacaggcgtgagccactgcgcccggccaagggggggggtccagttttaatcttctgcatatggctagccaattatcccaggaccatttattgaatagggattcctttccccattgcttgtttttgtcagctttgtcgacgatcacttggttgtaggtatacagccttatttctaggctttctgttctgtcccactgatctgtatgtctgtttttgtaccagtgccatgctggtttggttactgtagccttgtagcctagtttgaatttggttaaaccaacttcaaacctgcagctttgttttttttttgcttagcattgccttggtgttttgggcttttaaaaaattctgtatgaatttttaaactgtttttttctaattctgtgaagaatgtcattagtaatttgataggaatagcattgaatctgtaaattgctttgggcagtatagccatgttaacaatgattcttcccatctatgaacatggaatgttttttcatttgttggtgtcatctttgatttctttgagcactgttttataattctttaagtagagatctttcacttccctggttagctgtattctattcacatatcttttatttccctggtattttatttttttgtggctattgtgaatgggactgagttattgatttggttctcagtttggacattggtatataacaatgctacttattatatttttgtacattgattttatatactgaaactttgctgaagtggtttatcagatcaaggagcttttgggcaaagtctatagggttttctatgtatagaattatattgtctgcaaacagatagtttgacttcccttcttcctgtttggatgtcttgtatttctttctcttgtctcattgctctgggaggacttccagtactgttgaataggagtggtgagaaagggcatccttgacttgttctggttttcagagggaatgcttccaacttttgcccatttagtatgatgtttgctgtgggtttttagtaaatgggtattactattttgaagtagtttcttcagttactagtttgttgaggttttttttttttaacatgaagggatgttgaattgcatcaaaagccttttctgcatctgaagtaatcatgtggtttttgtttttagttctgtttatatgatgaatcacatttattgatttgtgtatgttgaaccaatcttgcatctcagggataaagactacttgatagtggtggattaacctttttatgtgccgctggattcgatttgctagtattttgttgaggattttcacatccatgttcctcgagaaaaatggcctgaagtttttttgtttttgtttttgttttttggtggttgttgttgttgtatctctgtcaggttttggtgtctggatgatagacatagatggacacctcatagaataggttagggaggagtccctcctcctcaattttctggaatagtttcagtaggattggtaccaactcttccttatacatctgatagaattcagctgtgaatccatctggtcctggtcctggttctacattttgtagcttgtgagtatagaggtgttcataataggttctgggaattttttgtatttctgtgaggtcagtggtaatgtcctctttgtcatttctgattttgtttatttggctcttctctctttttttattagtctagctagtggtccatctatcttattatttatttatttattttttttcagaaaaccaattcctggattcattggtcttttgcatgttttttcacatctcagtttccttcagttcagctttgattttggttatttatttttgttagctttggggttggtttgcttttctttctctagttcctctagtttatatgagtaacccttattttacttaataatggccccaaagcataagagttgtgatgctggcaatttggatttgccaaagagaagctgtaaaatgcttccttgtttatctcttactgtgcctaatttaaaaattaaactttatcataggtatatatgtataggaaaaaattgtgtatgtgtatatatatacacacattatatacatatgtatatacacattatatatctacacacacacacacacacacacacacacacacagatatctagctagatagtaccaaaatatatacatctgtggttttggacatccactggaatgtatcccttgtggataggggggactactgtaatcacaaaaaactaacagtatgcaagtacttcatattttataaaatgttatttaaagaagaaaacttgttttttgtgtttgccatttattaaatcatattctttatacatacacgtgtgtacacgcacgatgtactgagtctcctctctaggctctgtggacaaagtctttgggttatttgaacgcagtcttctaagagatccgtgtcagaggtcttgtcattacatcaccatgcctgcttgaagccagatttctttgattcacccaggcttatgatctgcatttcattccagtcttcttggtaaatattttttatatatgtggtcaagttctctttgtttggaattttgataatgagaactgcaagtgttgattaattataaacctaaaatgggattgaggcaattgttaactcgtcgtggttttgctgctttccctccttattggagaagaattaggaagactttataggggactgatggaaaaataatttggcatgaccataatttgagtcagagaaagtctcttattaaaattcccacaaggcttatttaaggagcaagatcttttgaaactaatggtgtggtacttacttaatccacacaagttatgatttgattgtcatcttctttgatttttctgcttggctttctgtcatctgatgagagattactgcattacctgagaatctcatcttattagagtcacctctacctaaactagaatccattcctaaatagtaacatactcgcatcaagaaagagtaagtatcctcggtactaaattagtgctctagatgcctttgtacattttttttgttgcacttttccggactttctagtggccagtgttgaggtatgggatggtatgatggtggcttcattcaactttttagcttctatcgagcttccctgtcatcttgctaaattccaaaggtgtgttctttcctcattcttggtcacaacaaaacatcacctgagacgggatcagtctgactcgcccaaccagaagggatgatgtgtttgagaaatcctgtttgtgacactggaggaagaattgtgactgttcatatatgatacatatggaattgaaacttgtccttaaaagctctggcaggtctctctttgatggtttttagggacaatagacttttgaggtgagagtttgtagtggcagaggagcagaactttgaaataggcctaaaccctgtactttggatatgggccagacccatttgtgttccctatggggctggttgacaagggaagaggaagctctactatacattctcatgtgtttagtgtagcttaactctgctgattcaagatgggctaattgtcagtgtaattcctttgaattatctctgtgatgaagtatcagctggagcttgccagtggcactctgggccaattatgcagccgactttgaaaaatggtatgattcagaatgtcagagttgctaaggtgatttatgaagaaatcagttcccatcagccttcattattcatagagatgctgggaatcaggactttgcagtgacctggcccagaggaaataaaccaggtgggtatgatttagggtttctcacatagagttcaatagaggtgcctctgtgtatgtggtatgtgtcctgtaccgtgttgtgagctcatcttagagcaacagcagctattatttacattacatacttcctccatttcccaaaaaaggatataaggtggtagccttcacttacccactttctttctggtggatgcatgacattatgttatataccttaccaatacctccaaacctcacaaccgctgttgtagaacgaataatgtcctccattgaaaaatgagaaaattgaggcacatattagatgatttatgcaaaggcatccaactaccaagggcagaactcgtatagaacccggtccatctgacttaacaccagtgctcttgcccctaacctgagctgcttctctgacaggtgtattgccctttatattcatgttgcccagcagtgttcctggcctagcgtagctgccaataaaattgattgatttgatttgaatcatattcagcaccctggagtcactgcacgtcagcagcagcaccatgtgtgtagtaggcacttggtgcctactacaaaaggcacaaaagcagcaaagtagatagcatacccattttacagatgagaaaacggaatctcagagaggacaagtaacttgcctaaagtcacccgttaccactagtggcatttctgaatgtgagggccatctgatgtatctaatatcagctaaattcataattcttccagtcttccacatttttcacaaacacactcccatttccagaaacccttcatgtttcttccagttgcttgttgtctcttctaattccttgttgtatcacttaaattattttcccactcttatcctcagtgacctcatctctaaaaggaggataatgatgatacctaccttacagatggattaaataaaatagtgcagacaaaatgttgagttcagcatttaacagatgcaaatggtgaagtaattaacatacttcttccatatctatgtgtagaatccaacagtaacacagcatttgtatcctgctaacagagtgaggctgaactttaaactaaaaatatgtctactttaagatacaacacatttccagagatcacatcttttaagagaaatctcatctgcacaaatgttgttgcttttacttattcagacatcctttggcagacatcagacctcatcagactgggtaaaggcgatggtgagggaattctaggtgttagacaatagtgagtgagttcccataagacattagtactgtcaggctcggagcccgtcctcttcctttacccaagactgatgtgttgcttagccttatgatggcaaggaaattctaaataaccatgattaagaggcttattttagtttctccttccactgtgatctctcccagaaagagactcagaaatccttatacttggtctgatctcttcagcaaaacccaccttcagtagcaagcctgtggctctagggttggcccttattttgtcttgtccagcaggatggtgtctcttattcttttgatgatctcattctttccaaagtgtatttcttataacagaagttcttttttgtttgaataaacagtttaaatggacatgcctttagagataacttagccaggactggagccctgcttcttatcagacattacaaaacacagacattctcattaagtgaacagagatttcctttgatttcaaaagaatgttaaggggaattacttttaagtttaaaagctccttgagggcagaacgcacttcttattctacactgactcttcttagcacccatccagaaccttgttgcatatgatgatgccccatgtaagcttgcttcattggtttcagtggcttttgttcttagttgactagaaatgaaggataatttattcatttcttcaaccagtattacgtttagcatagtaaacaagacaaggtcaatcccttacagaacttatatcctagtaagagagacaagtaaaagaaaataaataaaaataattacaaggtacataattgttttgaagaaaacaagagtctgagatagaggataatggagaggaggcagtctttctagataagatggtcagaaaaggcttgcctgcatcctctgaggagttgacatctaaactaaaacctgtaggttaaggaagaacagggcatgaaccatgcaggcagaagattcattaactctgtaggccactgaggctggaaaaagtatggcctgtttgaggatctgaaataaagtgtagctgtagggtcctgagcaaaagagggagtaatagattatgaagttggaggggaggcaggggccagccatatgaggcccatgtagccactcatgagttggattttattctcagtgcaataggaaagaaacctaagggtgaggtgattggattcatttctgtgtttttaattatgtttgttgctgtgagatgatggcagcctggaccaaggtagatggagatggaaaaaagtggttgggtttgagttataccaatatttcagggacaaaattgataggactgctaaaggattggatgttggcaggaggcgggggtgagggaaaaggaaggatcagggatgattttgagcaaatggaagaatgatgataccattcctgagatggggaagactggggagtaaggagacaagatttggggatgaggaagggatgtgactcaagagttttgctttggatgtgttaagctgcagattctattagcgtggtggctcacacctgtaatcccagcactttgggaggccaaggtgggcagatcacctgaggtcaggagtttgagaccagcctggccaacatggcgaaac[140 bp omitted]cacttgcctgggggacagagccagactccgtctcaaaaaaaaaaaaaaaaaaatcagatctcatcaggcttactatcattagaatagcatgggaaagacctgaccatgctatttaattaccaagatttaattactttccactggatccgtcccataacatgttggaattgtgggagctaccattcaagatgagatttgggtggggacacagccaaaccatatcacagatttttcacgagataatcagggactgaaatatccagtgggagctgatctggatgtgcgagtatggagtatgggtatcacagaatagagaggatattcacatcctatgggatagatgaggtactgaatgggtgatatttcccatacctcgtgaaaacagctcaagctacttacatggctggattgagaatttgctgcttcaagattctggctgtagcaaaactgtagaatcacagttattttactgcaagatattcatttgaaatgtatttatgccaccaaggaccaggaaggtgaaatgctacacttggcgccatgaaactattgtctgagcttgtttttcggaaaaatccatatctggatgatatgactgagtcatcagcagtgcctggctggctgtgttgtaataggtcagatgtaacttaagccccaaagttcttaggacagccataaattagtctgaaggtggctgagataaggcaagggtgcttgttgcctccagattagaatcaagggcaacaaaactgcctagaaattggaaacccaggagaagctttaggctagagacaggcagcaatactttgtgagaattttactaacagaaaaataaggaagatacagaatcatgtttatcaaacttgaggatttataagaaatacctgtatagcttctttattttagtttatttttattattatttatttatttttgagacaaggtcttgctctgttgcccaggctggagtgcagtggctcagtcacagctcactgcagccttggagtgggctcaagcgatcctcccatctcagcatcctaagtatctgggactataggtgtgcaccaccacacctggctaattttttttcccccgtagagatgggatttcactatttgcccaggctggtctggagttcctgggctcaagcaatcctcccaccttggtctcccagagtgctgggattcaggcatgagctaccatgcccagcgtgaataccttcttcaaaatgcaaaatcctgtacctcacctcccagggagtcttattaagtagctttggactggggctcaggaatctgtgtttttagcaagtgattctgatacaggtgatccataggtcatacactgagaaacattgagtctggaaagacttctgagatcatctagtcagccctgtcttacaaatggggaaattaaggtctgaggaggagaacgggcttgcccaaagttgcagaataagttgcaaagtcagtgcagctccactaacttatatgtcttcattttgcaatttattcttcatcctagtggctagatgaaaagcaagtctaccctcctaattcccagctccccttctttcacactattttttattttcttttttccagagcaccttctaatataaaaataatttactaatttactgtgtttattgctattttccttgcttcattaaaatgtaagcttcacaagggcactgctttttgtttgtttgtttgttttcattaaagtagcctatgtgcctcgaatagcacctgacccatagtaggtgttcaatgagtatttataaatggatgggtgaaaaatattttgttaaactgtacataagttaacaggtattatgtaccagcccttaggcattagcatgaaatagagtagaatattttctttttcacatgtttgattctagcttgaattagaggttacagaaacagcttatttatggaagattaattagagacttaccaatcatatgtacaataataataagaataacaatagcaacaataacaacagtgataacatccatttgtggaatatttactatctgcccaacacatactatatgaagttctgagctaagaccatcagaccattatctcatgtaagtcttagtaccgccccagggtggaggaacaaaatagtattgtctgttttccaaaggaggaaaccgaggctcaagaggtgaaattactgtttaaggttacatagccagtacagatttaggacctgtgatcccaaagattacattcttaactaccagttacattcagtagtaggcttggggaattctctctttgcagaaggaattgaaaatgccaaagactaggcaagcattgctattaggggtgtccttgggccaagaacaccaacctctaaggtagtataaaaccacaggctggaaagatgcattttttttttcagcccgactttccagcatttacccacactctcaagtcttccattctcacattacaaagaacctttcgtcttgaactattagggttttctcacttctcagacaccctccctgaagcaggccaaggaaaattcctgtggtgacaggccatttctagggaggccactgtagcacttcacacttgctctcaccccacccactcaaggaagggtagacagacagagggccctttacccagctcctatactactttcctgtggagacctcaggaaagggccgaggatcatgattttctaaatgtgggcacaacagacctcttgtaagactttgagttcttgaaacactgtacctattaaactggttgtgagcacacagaataaagtatcaccacccactgtggataatgtcagcattcattcccacccctgacagccaatattggccaggcttggaatcactgaacacacatggcagcagagtcccttgccccatagctgcagacacaggttgaacactggtgtatccctgggcttttatgaagagagaggcttataacacccattgccatctttacacacacagtgcagcaggtactgtgctgagaactttacagccgtgatcttatttaattcttacaatacatgtgatgagacactgctgtctgacttctgtagatggggaaggcctggagagattggtaacttgacagagtctcatggcatctgcaacaggcagaaccacattttaaacaaaggttgagttacttctaaaacctgtgctttgctagtcttctgttctgcaacactggttaagagcatagactctagagccatgctgcctgggtttgagtcttgattctgccacttactagttgggagacattgggcaggttacttagctaccctcctccttgggctgttcatctgtaacatagggataataatgtccttgtagcatgggttgctctgaggattaaaggaatccatatatgtaaagcactcagtgtctggtgcatagaaaacactaaatgccagccattattattaatttatatatcaactcattgtttttctttggatgatagaaacttaatctcagaagtttgaggtttttctaactacccacccttaccccaacccctgccaagggttgcgtctgtattcccaaggggcttagactgttacctggtatatagtagcctcaagtaaatgctggtgatgataatagggcagtgccaagacattgggggtgtgggaaggcagggttaggggatggcatctgcgcctcatcagcatcgatcctccatggtgtcgtatcctgaaagtgggaaaggcgctgtccagatagacgcttatctcgtagacagaacaagaacggggaggcaaccattatttcacatacagcaagttactgttattttaatgccctaacaatgaatctatatttaattaacttaaaagataggggaggtgagagtattattcactaagttcttggtcaaggcacattaaatcaaagcggttagcacttagatctcttccagggataaattatctcagacaagcttcaaggtatgccatgctttggaatgaattgtcactttccaaccaccaccactcaacctgtgatctgaccacagtgtcttcctcctgtctcccttccctctgggtgcctgggaaggctgggcttctgcactgttctgccactgacttaagctttgtcgtgactataccttccacttctcttctagcttaagagttggacagtggaggaccttcagaagaggctcttggccctggaccccatgatggagcaggagattgaagagatccggcagaagtaccagtccaagcggcagcccatcctggatgccatagaggctaagaagagacggcaacaaaacttctgagcaaggccaggctgtgagggccccagctccacccaggctttgggtgaattctggatggcttgcctcatgtttgttagccagcacttctgctctgtcgtctctccacagcacctttgtgaactcaggaatgtgcgccagtgggaagggctctcttgacagtcagcgtgccatcttgatgtgtgtatgtacattggtcaggtatattatctcaaaggatttatattggcgcttttaactcagagttttaaaccccaggaacagagactcctagttgagtgatagctgggaaagttttacattgtctgtttttcttctcccaatagctttcaattgttctttctggaagacttttaaaaaaatataaatatgcatatatatatataaattataaatagattccccacgcagtgtggtggcatctctgtacaggtacagttttaaacggtttgcctcttttctgtaagattatggtactgtggaacatgagggcagaggacaccgggaggctgttagggggtcactgaatcccaggagccaacctccccctttgcagggctgcatttaaaaattaggtttgggacagttcttgtaccgtggtttcagccttgtgtggtcatcactggcttctggagctattggtgatgtccaagggaaagctttgagagtttatgtttactctttgagtcccaggagaagcctggcaccctctttgcaaattggcctttgctctttcaatgcctttcatccatctccactctctcaactgcctaaagtcacagcacagatactgcccagtgccttaagaggagacatgatctctaccagggactctcagcaaacacgggactgtgttcagtccacaaaggaaaagcgtttttgaagctctcattgttcatgtaaaaatcatacacgtggcatgttgctccacattccttacacacaggggtagaggggattgcttttgtgacccacgttcaaatatgtgactgttttcttttctcttttactgctaagcagcctggaaaggataaatgaatattagactaagatttgttttccaggaggctcaatctgaacacacagaatgtcagagctggaagggactatagagatcatctgatctgatcctcttgtacggatgatcgcaaaactgaggtgtagagaggggaatggccaaaatcacaaagcaagttagcgttaagagctgagactagaattcagggtcctcactcccaggccaccgaaccatgcagccccttctttgggggaagagacctgtgtcagtcttggttaattgttccagggaaccttgctaacagaaacttgctcttgccttggctcttcagtagatgacctggctgtaaagagattccctggacgagccagatcattcagtttcagcgagtccttgagctccacaacatctaccagatatagcagacaagcacccatggaggcaggtttcgggcctgaagcagatcagagggctttgcaaaagacagcatagagccatcttcctgcaactttacctctttccctcagatggggagccatgactgggttgcacctcaggatactgtaatttgactccataattgcttttgctcctgaaacctgggaatcaatggaaaggcagggaatgtgcctcttctgtggccagattctgttatttgcaattaaagcaagtttttaaaaaatgcaagaggcagttgttagtcttcagggcttggcaactgaaatagctatgtggcggatacggaaaacagaggacaatttgaggatcttgctggaataataaatgacagctaccatttgttgagcacctattatatatcaggcactgagctgggtaggctctaaacttcacaataaccctgtgacttaactactttatctccattttgtagttgaagaaataagttcagagagaaagattccttcccaaggtcatgcagctagtaaatgatagaatcaggattcatagcatcactatagggggtcaatatttacacaaaaaaggaaagtcacaagcctgtttaaaatgaagtgaccaccttttcttgcatagactaaataactcgaactggcatttttaggttggaaagacagctgaattagtagttaagtctgatagccaagtaagttttaaaaaccaaagcatccaggatgcacacccctgcaccatttgctgtgcgaattaatagttctgtctctctctctctttcttttttctttttattctttgagatggattttcgctcttgtcgcccaggctggagtacaatggcacgatcttggctcactgcaacctccgcctcccgggttcaagcgattcttctgctgggattacagcatatgccaccatgcccagattatttttttgtatttgtagtagagacggggtttcaccatgtcagtcaggctggtcttgaactcctgacctcaggtgatccacccgcctcagcctcccacactgctgggattacaggcatgagccaccgctcctggcctctctttcttttttaaacaaagaactttgcacttggccagagaggaggagaaagcccattttctcccttcctaagctagatccaaataaaagaaagttcagttttcccccataactattcttgggtcatgaactttgatctggagtttgttttgtttcaggaatgtgtgcacccagcttgctgatccaacaaagtctattgcttaccagtctagcttgatgaagccttttggccagaagtcaatttgttttggatcagagaaatttcctgacaaggtatatttgttttctagtgacagaaaggcaaaggaacaagtcctagttgttgttgttgttgttgaatactaaatttaagatatgtcagcttgctttcaatgagccttgggcttctgttattgcttgagcatttggaactcgagcttccagagaaatttgaggtcctcgcttgttctctgccttcaagaaacaatgacctgattctgtctttaaaaaaaaaaatctcagaattctttttttgtttgtgtttttttttttttttgagacagagtctcactctgttgcccaggctggagtgcagtggcgccatctcggctcactgcaacctccgcctcccaggttcaagcaattctcctgcctcagcctcccaggtagctgccactacaggtgctgcaccaccacgcccggctaatttttgtatttttagtagagacagggtttcaccatattagccaggtgggtcttgaactcctgaccttgtgatccacccgcctcggcctcccaaagtgctgggattacaggcgtgagccaccttgcctggccaaaaatctcagaattctttaagactgttttaattgctccatcagtaattttgaagcactttcctttttttttttttttcccctttttgtccctttccccaagccaccaattggatggatgaatgtttgacggggaagaggaagggtaggaggatgcatggatgagtggatgagtggatcgatggatgtattgataaatagatagaaccagtcatctgaagcaacttaagaattgtagccttgactccttgagactgtagatttcgatccaggaaacatttatttagcacctgccagatgccagaaatttataccatttaaaactcagtaagtcttttaaatatcaggaaggagagaagcgacatcatgatacatcctatgggtattaaaaagccaatagaatattatgaataattttatgctaataaatttaacaacttcaacatcataaacaaattccttgaaaaataaaaagtaccaaaattcattcaagaagaaatagataccagcctgagcaacatggcaaaatcccatctctacaaaacatcaaaaaaaaaaaaaattagtcgggcatggtggtgcacacctgtaatcccagcttgtcaggaggctgaagtgggaggatcacctgagcccagggaggtcaaggatgcagtgagccatggtctcaccactgcactctagcctgggtgacagaatgagaccccgtctcaaaaaaaaagaagaagtagataatctgaatagccctatatctatagaaacttaatagtgctgggagatataggtattattatcctcattttacagatgtgaaaattgaggctcagagaagtaaagtctattgctcaaggtcatgtggctagaatatggcagagccatgattcagatccaggtcttctgattcttattccagtgtcctttctagcataccatgttgcctctaaagattgcagctccttatttactagaaaattgttcctgcccaatctacatctccacctcaccccatcttttcttaagcactatgtttgtgtttttatcagtattatattcattgtctttggaatacatgttcttgtttgtgtttggaaaaaaaatctcttttaccagcttgcactcggaccaacttggaaaaaaaaaagcttaaatgtttttgctatgtacagtttaaaaatgtgaagtttgtagctttaactttttgtaagaaaatctaataacactggcttaagtgctgacttgaaatgctattttgtaaggtttggatgtaagtaatcaattgaggtcagcagtttgtatgagacatagcttcctccattgcccccactccttttttcttttttaagtttgagatgcttcctgtgtttttatgttagaattgttgttctccttcttttcttcttcctatacctcatcacgtttgttttaaataaactgtcctttggaccacaaacccttattaacgagaacctcaatatatagcctggataatggtgttgtgaacaatctttgtgacattgactcagtggtgtgtttattctaagatccaaagctggggagaggttggtaaacttttgttgggcttctattatgtgccagggtactgagctagttatcaggaatataataaagatgaaccagatacagtttttgcagggcatttggggagttagccaagcacaaaaacacacaacattgaacataccatggtagaagaaggtacagggcctgtggatacacagaagagggagtgacggttctgctgggatgtccaaggaaactcttctagaggagacaatataccttgaaactttaaaaatgaagaagagatggctagattaataaagagtaggaagtgagggagagaagacatcctggacagaagagcccgcctgtataaagcctctagtgtgagatgatcaccttggaatccttcatcctcatctgctgctgcacgaagccaggccagacgtggcccagcattcagaggtggaacagcaggttcctgccctggtgtggcccattcttatccaggaatagttctccagcctgaccctaggtttttttttcagccttaaaagttgaccccacggcagagagggaatagagttacattgaaaagtaagtgtagttctcttgagtgaaattgctctacagtatttaatagaatagttccacagtctgtgtatataactgtcatgttattctgtgggcctttcttggagtggggtgataagtgcgtttattgttccctaacttactcacctcactccttgaaatatttagtgtaccttccttcctgtagccagggttgatgacagatgttccttattgatcacactgagaacctatggccagatgaaggaaagaaggaaggatgaagtaagtttatatttattaagcacttattatctgccaggcacaatgcagagccgtttagatgacttcatttgtcttctcacacacactcttaggtaaatgatagtgtaccctttctatagacatatggacttttacagtgtgcagtactgcccaccagggggtgttttggaaatgtatgagagtgtttttgtggtgatagtgattgaggagccttaccagcatttaatgggcaggggcaggtttgctagatgctctgcagtgcattctgggacagtcctgcataacaaacatctgtccggtgtccaacacaacattcagatgttccactggttattaattttggtgaaaattttgtttataaacgtgatactaaaccaaagttcatttacatgtaaacacaaagtactttttatatggttttactgttttgttttttttaagaatgaactatgaagaatggagagacacttgtagtttgttttgtttggacctttactaagagttgttctccatttcagaaaaccacatcatcagtgacagcgatgcttgtgatttttgagtcactcactcaagattggtttagatctgtagctgttgttttcacagaaagtctatgtaacatgtaaacacatggtaatttcagagaatgatgaagtacagcaaaaagaaaagaacagggtaatgggattgagagtaacgtgtgcatgtgtgtgcatgcacatctgtgtatgtgtagggagagatggctttatatagaatgataaacgatgcttctggagaaacgatgtttataatgagaactgcatgacaagaaggaaccagccaggctgaggggacagcaagaacaaagaccctgagataaaaacaaaagtttggcttgttggaagaatggaaggattcttccatggctggaacagtgtgtacaaggtgggtgaaggcaagaatgttcagggccttgtggtccatgggaaggggtttgggtgttattcctgatgagatggagagccgtcaaagggttttaagcaaggaactggcatgatagatttatgcattttgaaactatgccttcatgaaatagtgctcaactttagtcatcaggaaaatacagtcagccctccgtatccatgggttctacatcaaccaaccatggatcaaaaatattagaaaaaaaaaatggcccagcacagtggctcacgcctgtaatctcactttgggaggccaagaactcatttgaggtcaggagttcaaggccagcttggccaacatggtgagaccctgtctctactaaaaatacaaaaattagctgggcatggtggcaggcctgtaatcccagctactcgggaggccgaggcaggagaatcgcttggacccaagaagcagcagttgcagtgagccgagattgtgccactgcactccagcctgggtgacagagcgagactccatctcagaaaagaaaaaaaaattgtgtctgtctttcttccttaaacaatacagtataacagtaatttgcatagcatttacattaggcattttgtgtagcattgtattaggtataagtaatctagaaatgatttaaattatacaggaggatgtgcataggttatatgcaaatactaggacatttcatatcaaggacttgagcatctgcatgcagattttggtatccatcagagttcctggaaccaattcaccacagataccaagggacaactgcacagattaaaaccttaatgcattactaccgtgtacccaccataataactaaaatggaagaaatagaaatgctaggtattggtgacgatatggagcaactggaactcgagtactggtgaatatacccatgacctagcattccttccctaggtattttctcaacagaagtgtgtatgcctttttaccacaagacatatactagaacattcataatggcattatttataattttgccaaactggaaaccatctggatgcccagtggcagcataaataaattacgtagattcgcatagtggaatactatacaacgagaatgagctacctatagctactgtggaaataagcaaaagggtattgtgagcttgctacagcaaagaagtcagccactgttacttgcattttggcagagactcaaaggcaggcaaaggaatgggaaagtagaaaaaaaaggaaggcttcagggatgccctgttggaagctgttggcatgggaaagctgtaggtgggctaacttgaagcaggacatcctatgtgattgatttaggggtgcatatttggtttctctgtttgatcctaagttggaagtggggacaaaaattggggaagctgtcagttattaatcaagtcctgaccattttggcttgattgttacagaagttattgtttagcttcctggattgccactggagatagcaatctgtcttcctgcaagtctgacttatagcaggctggcaacctgggctatttattgtagatatggggttggtttcctgggcaggttactgcaggttgtgggtcaaagttctatttatatatatattctgggattgtccatttgtacattcagtctctcactacatgcaacaatatggctgtatctctcaaacatttaaatgaagctagacacatccatcgatggatgaatgaataaacaaaatagggcctacacatacaatgaaatattattcagccttcaggaggaggaaattctgacacatgctgcaacatggatgaaccttgaggacattatgctaagtgaaataaaccagtcacaaaaggacaaatacatgattggacttacataaggtacctagagtagcaaggtctcttcatagagacaaagtagaatggtggttggcagagggagggagagagggatggggagttagtgtttaatgggcccagagtttcagttgaggaagatgaaaaagctctggagacagatgttcttacaacaatgtgagtgtacttaatgccacagaactttacacttaaaaatggttgaaatggtaaattctatatgtattttgccacaataaaaaatccagatacaaactagtacatactgtgcaattctttttatatacagttcagaaccaaggaaacctactctatgatgttaaaagtcagggcaacgattgcctttgttggttgtggggtagtgactggatgtgagtatgaggagggactacagtgctactcaggttctaattctttgagtgcttgttacacaagtgtgttcatgatgagaaaatttatcaatgtgaactcttaggatctgtgcttttttttcccatatgtattttatacttgaataaacaagactttttgccttctactccactgggctcttttagaagcttccaagaccatggatgggaaggccccttggaaactacctaggcctctgcagatgtaaggggtggttactcttagcccatgagcatttatcccagccacatcttgttctgatgaatgatccaacagaggcccaagacttggcagtgtcaagtctggattcaaacttaggcttcttgactccagtgttcactccaggaccccaactatggcctcaagtgtgagtccaggttgtgatctctagataagcaaaccccttcctttcccagtgccctctgcttggagttgctttgccctccagaggaaaacaagagccctggtagaggctgctgagctctatttccttgctttgcattttttgggcttctttaatatttaaccttgtgccaggcattttcatacatattatcttacttgaacttgcccataacgctctgaggtgtaggtgttattaaaccaagataagtgaagaaacaggctcagagagacaaagaaacccaaccaagatcacacacctcataagaagcagattcaagcccaacttgctggacttaaccacattctttcctctgcatcgcatggcatccctcatattctcccattttattcaaatattgtaaataactcactgtctgaagccaacacagaaacacagagcagagagagaagcagggaaaaatgacaagatgacttcagtggaacctctggatccacctgtacttaagtcactttgttgggtctctttcacttgtacctgaaagattccttattgatctaggtatgtaggaaaagatggcagggaggtggggtgggggttggataccagttgggggttggtcctgataataataccccttagaggtcaacaggtccaatctagggtcacacactgatgagtggcagggccaatatttgaacccagatgtgacttcaaaaaccaaggtgtgtgcaattcttcctcttgaatgaatgaatttcttgagggttctgaactctacccttctgagcaaggttaaataccagtctacaactgcccttgtccttttcttcctttctagcagacaggattctgaaagacattccctgtgccaccccctccccttccttctcaaagactcctgtcttagaagattatcttctcaacttactaacttcctggagaattctttccacacaggcagggccggactggcctgaagtatgaggtctggtattgaggaccatcccagccagcacctcagggctgtttccagagccttcagatagaagaaactcattataggacgcacacttcaaagccacttccttcagtggtgcctggggagttaagtttaccagacaaagtgataatagtgggaagtggtgctgagtgagtacaatctggtattaaaaagcctgagtttgaatccctgatctgctactttttaactgtctgaccatggatcttggttttttcatctgttcagtggtgatactactattttattgttgttgctgttgtcttgtggagttgttgtgagaagtatatgagataatgtatgtgaaaccactttgcaaattacagtgacaaggatatgtggaggatgactattatttgctaggctatcttcactcttgggggcttcaaagagtaccatataagtcaactggagtcttccactctgatgtcccagtgtaaacaccctgcttggcccttatttgagctgaacagctcttcttactcaaagggattgaggaatgggatttgcttcttgtctgaccttggacttctgggtctctcttttctgatctgtaaaatggggctggagagggggcagatcttcaatctgataatccctaaggaatattatgtctcactcacaagggaagtcgccaccttgaggtcactgcaaagagggggaaactcagtttgtttatcattaacaacaagcacatcacatctcagagcccagatgtgctgagctgtcccacatgcccccagttgctccctaacatctctggacattatccttccattttacagaagttgaaactgaagaccaagagagcaagactgcaagggattactatgagatccgtcctgtactccctcttctgggaactgcttgactcctaccccagccataggttcacatgatccaaccccttcgccacagttgagtgatccagtcatctcacccaaggtgaccaatctctgggccaatcagatttttcaaactggaaatgggaagttctctagtggaggcgctacaagataccaaactgggagatgttggtaaccctgttatctaccatgtgatgcagaaaccaatttctccgtctgtctatctgtttctctgtctctctctctcattcttgatttcgtcgttgctgaaaccaagctgcctggctgccattctcactcagtggtattgtaaaagatatgtgttggttttgtctcccctggatcctttcccctcattttaatgaaaggaccctcatcttccttcagggagctacccctctgccatctatgtcctggtgggactgtctgtgatagttcctcccatctcaccccgaaatcatgtgatgagcatatgacccaaaccagtctagttagactcaatcttcagagaattttttagcttgagcagagtgatttatacaatggaggcagttgtcactaagctattttaattgtagtgccccaaagaggtgatttatgagttttacctacctcaatccctatgttgctcgaattgctgtctttctcaaagccttgttgtttaatttgactttgatcctatccagtacctttccaatgcagtccttttttggcttaagttttccagagttggattctgttgtttgcaaccaaaaattcctaactgatacagaaattggaactagagttgagttgtagacaccatatcctctaggaaatgtgggatatttcctaagactgtgatggggcaaaatacaatgaggttgttgctcatgctctagtctgggaagccagcaatggtctgcaatggtaaagacctatgtcttacattacttcatagcatctgaccactgaggaggctctcagagaagggataacacgtgtcacagttaattttaaggaagtgaggagtgttcaggctgtgtgatagagtattttgtttctaaccacatagattaatataaagggagagtcaacaaaggaagccccaatgcctttttttttaacataaaaaaaattcataaacagaatgaacggacagcatttctatgactacggtaaaagactctcttatgacttgcagtagggcctagttctccaaataccaaagttggcaattgatgatgcaggctgctgaattcacagccctgctgcactttgtgaagttaggcattaataggcagtgggattatgacaagtggaatgatcatatgagaggatgtgggagaaaactgaaagctctctaaaacactgggtgcaaacaattcacaccttttcttagaggagaaagctcacaattttctgcttgccccatccctcaaggctacttagctggaaggtggggatcagtttggcctagagcatgacaagtagacacagtaggtaaaaatcctggacccatacagaattgaagaaacttgttaactgacaccatcaaaaatttggggaagtatctgtggaaatggatttttgtggtgctttatcaaggaagggggaatgtaatcttggctcaggctgatcttcttgatatggtttcacttgccagggattatttggcattctctgtgctagctccaggagctggcaaggctctaacaatgtgatgagttggctaatgcaaacttaaaacaaatgctggcccacgtgaaatggaacttaagggccccaaatcccttggcatcatgtagaagaagagattcaaagatttctgaaagacaggaggctggattggatctattttgtgcctccttcccacaaatacctctaactgtagccctcacactttacccttgctttgaggaaagtcaagaatgctgggtggaggggctgcaatttgaaataggttgcctgattcagaggggaagaagaatgcagagatgtgggaggccaggcgttggcacttcatcctcagaaatgaagtgggagtgatcactggaatattcagtaggctctgtatgaggcaagaactcatggtgtagtgttacaggccgaaatgatgagggtcgtgatcaactccatatactactggaggctatatgagtaagcagcaaactgtttctcataaatgcagaatgttggcaaaccgacgaactgcatctgccacccggcaggaatgctgagggcagtcacgtcccaagcatagtgtttcttgtgattaggtacatctgaagcctgttagtaacaatatgaacctgtgatcagttaagcagctgaccaatcattacctcctcctccctgctcttgttacccaataaataggaaggactgtggaagcttgggggctgcctttgctcactagaagcggggagctctcttcttcttccccggccccttcctttaaaatagtttcttttgtcttaagttttcatttctatgttcgtcccttcattcagtcttgtaatgacggtctcaggcagtaacagtagtaagctgtcgtaatgatggtctcaagtagtaaccgtggcacactgccacagtgtagggccctaaaaagttaaaggcaacccactaaagtcttacttgatttgtttaaccagcaaaacataagaaacaaagcaaaatggaaaccaaaaacaccctctagttctggcaaaaaaaaaaaaagtcacgacttgagccactgtgtaacactgggcttgcgtttattgatctaaagccctttgattgaaggatatgctactcacctttgaggaaggactctgctatattgcatgagtgtaatgtgaatatttctcttgccttctccaaaaggatctgtggccatttcccaaggtaaatggatactggggaaagggaaatacaccattcagggaaccttgatgaagacttcgagctaataccagtttcttgggttcaagagtaccactgtaggtccatctatcatgtgaaaaagtgttttggcttttgtccatgccactggaggcctaatggaattccaaaactattctatatcagcagtttcggagagatagttggaaaagatccccatattggctctctgacccatgaagtgagggccattgtgatataaaaggccaatagaatacaactgaacaactgtttcaaaatagaaaagtcaacgatagtaacatatctttaggggaggctgcagagattagtgtttctaccaaagaccttgcaggctgatgactccaatcaaaacaccattaatttcctctggtaggtgcaaaattagatgggtcttggaaaatgacagtggattactttagtcaggtgataattccatttttaactgttgtgttagatatatgctcatcattacagtccctggagtcatgcatctactagtttcactctctactctgaggaacagaaaccactggaagcattttgctattacctagaagggataagagttttcatttactgttctaactcaggcatacctctgttctccagctctgtaacaggaaggccttgattccccgaatatccctattctaaaagacagcaaactaattttgactaaatcagttgactaaatcacattaacagggcctggagagcacaaaggagcagacacttcagctctgtaggtaagacacaccttttacaaggtgggagataaatccagtgcatctcagtgaagtttcttagagtgtccagtaccctggacatatgtgtagtacttctatcaccacaaaagaagtacagtgttaatttggattttgttgcttctaccgctatcagatcctggcttgctactgggctttgatggtgaatgaaggcctaactatgggatatcaggtaatctgatgacccaacgtgacaaactacgatatcatccatccagatagaaagtcaagcatgcctagtaaggactccatcatcaagtgtatccatgggtacatgggatttggctcacgtagaccctaatgatgtaagttgattgcatgagaagtttgctttcaatcaagttgcatgttttctgattaaacccaatgacccacttgcaaatctattgcttcctatcctatgactctgagctctgctgacttaagagattttggtacccaagggaagaatacttctttggtactcaaggaagaataccctgaatcggagactgagcctgtcacctggactttcggagcttttcttttccctatgtgtgtataaagggagttacagtcttgattagggtaatcaaccaccctgtcaaggggaaatatggttactgctacacaaagtaggcagaaaggaatgcaagtaactccatggaattccttggggaatcttcacatgccagcaggactaacaagtgctcagattcgctaggaataaaggtttaggttaccccatcaaaaaaagaatcccaaccaactaaagtgctggccaaaggcagggggcatgacatggctcacagagaagggatgttataaatgccagcagcagccttatgaccattacagaaatgaagacatagcaatggcctcttttcctccttgctgtgtttttcttttcctttcctctagtatcatatagggtatgctggtggcagttacatttaccatttattccttatattacaggatattgagacagaattagtggtaccagtggaagaatgaacttatagctggattcatgaacaggatatgccccatagggtgtctttcctttggggagatcggtatatgttggttatatataagagagtttccttatgttagaaacatgcataaatcgtgtgtatgggaaaaggatgggagtgtatggtatgctatttttgcttatcaataacttttgcctttcttttggtgacaataggtggtcttttatttgggtaagtacctttcctccaactgccgcaaatactaatacggtaccttgccctccatccctcccaagagagaggcatatgactcaagtgaaatcagactctctcctgggattggaactgtgagcaggatgatacagggaaggaagttgactggaggcagatcatgtgggtagcagtgtcttaaacagaaggttcatgagtcttgctactgaggtccctagagctcccctcattcctgtatttcctgaggcctcgtcagtcagctcttcctttggtcgggtgaatttcacagatacccttctgtagtgggccagatggtggccccaaacacctgtccatattttaatctctggaacccgtaactattaccttatttgggaaagggtctttttgcaaatgtggttaagttaaggatcctgagatgaggtcatcttggattatcctggtgggcctaaatgtcatcaaaagtgtccttgtaagacagaggcactggaagacttgacatacacagacactgaagtgagatcagaggcagagacttgagtgatgcagccacagccaaggaaagccaagaatggtggcagccaccacaaactagaagagaaaaggagagggtttccccctggagtctccagagggagggtggccctgctgacatcttgattttggatttctggcctccagaactgtcagagaatacacttctactgttttaagccatcaagtttgtttgaatttgttacagcagctgctggaaactaatatatcttccaataaattcattttttgcttgatgtcagtttgttgcttataccctcaaactctaattgttaacagtcattcatcactttaattattttataaattaccctttttgaccaagtttgttccaactgaattcctgtcacttgcaacctgttctggctggcacaaccacaaagtttgtgccaaatccaggactggagcctgagaatgtggattccaagtcattccacatattgcccaccctctccaatcactcagacagcatgtcagggagccatctccatacaagcagaaacacgtcctggggcccagctctttatttgcataatggttttcactgatacatgggaaggggagcgagttgttgcttttctgccaggaccacaaacagcctcatggtaggctcaggccagatgattccctcttgagctttctccacatcagtattagggacctgtttgtagggtcagaaaatatggaagccgtcgggtttcttggtgtgttctgcaagaccataagggtgctacacgcagcccttctgatctgcccctaacctgggttcagctgggcctagatgtaaggagcagagtgtgcagaagggctggtatgtgtgtggtgaattcaagggaggccctttgctgcttagctccatcctctgttccaatctggagacccagaatccatgcgtatgtagggggcccactatgtactaggccctgtgtatgacacacaccttcacacatgccattctctctgcttggagtactcccccctggaacctcatttgcttaattagcaatttatcatttggatggcaggttagattgtcacttgctcaggaaagccttctcactttctcgggccatggtccctgatacattatacacacctgtacttagtagagctcgctatatttatgtgattattgcattagagtctatcttccctactagtcggtaagcttcatgagtatagggatatatttttccaccactgtatctcttgagactagtaagcagcccataagtcagaagccagtatatcagagtggctgggcataacacaacggcatgtgtgtctgtttgtgggtggcagcgggggagacactatggggaacctgagagtgcatgcctcacgcaaaggcattcagattcttaaaatataataaaaacactgttggactaagccgaaacatgactgcaggccacacatgaagccccagtttaagactcttccaacgggtatttgttgagtgagtgagtgaagaacctacaaggaatatattgtaaaaacttcaagaaccaagcagggacagggcaggcggagctgaacggacctccttttcagtcttgttcacacctttttgagggccaggtctctctctggctatctttttttccccctctgagcttggcacccagtgggctgtaggaattggttgatctattcaacatttaccaaatacctactctgcaccaagcccagagttcaagcagacaatgtcttccatcttgaggctcagggtgatgggacagagatagccacagtcagacaacaacagcacagtgctgggtgctgtagccacagtatgtggaaagggctactggatcccctcctctgactttctcagcaagtgaagagaagattcagcaggtgggtatgagagatatgcccccagcaagggtgagggggctggagctggccagaagggagaggactctcacacatgggcctggatgggtactctaggtagggctggacaatgtagggctggacgtctgtgtgatgggcagaaaggaactgccaaggtcagactgttgggggagggtcttagaagccagtattcatatatgtcagccctctgaacatttcagagctgagctggctttaagttagagacccctctgctctccttggctttcattgccctctgggtcacagattctgaccatttgacagaggggctggaatctggacttgggggcagggattggaccactttacacagcaggtcttggcgcagctaggttgtctagatctcaggccaggggcccttcagattttctttctctcacatcagccctgggaggaaggtcggaagattattgcttagcaaatcttgcataccagctaaagaggcaagtacaatgctatggtacttcctcccaggactcatcctccttccctccaggactcatctttgattgctgactcctgttggatgctcctagaaaggaaccacagctgagatccagagctcctatatccaaatctcctgtctggacccttccctggctctgaaagggatttcttatcttgtggatcaactctggggatccatgaatcaccaaaaaacacacgcaaacttcatgagggcagaagaaagatggagttgatggagcattgctccaggcacaccaacaagcccagattccaaacctgactctgccacttctaattgtgacatctgggagaggcatcgctcatctcttagccttggtttcctcatctgtgaagtggggataattctctttctccaacacaaggccaaacatgacctggttcatgtacaggaggtgctcaggaatcattagtatcctttcaacttcctccctctggctcatgcctgcttcatgaatggcttggaggcaggtttataaagctttctgagttgcttgcagaatctcacagaatctagggtagcactgtcctgtcctgggcctttggaggaaggaatgcagcttttgaatctcatttctcaggacagcatgagtgatcctgggaggctcactaccatgaagaactttagcaggggaggaatctctactgtaggggcatggcagggggtcacggatccctggttttaatacatctgagggtgtggaggctcactgggggcctggctctctagatctgcagactgtccctcctgagaggtttctcgggatgtctccagagatgcctccgacaccccatcaatgctgctcagcaagtcctcaaactcttggtggttgctgttgcgcacggctgcctccagagccttctggcgccggtagaagtgggagaacttgttgaagatgatggtgatggggagtgctaccaccaggatgccccctaggatgcagcctgaggctgccagcttgccagccaccgtcactggcaccacatccccatagcccacggtggtcatgctcactgtgccccaccaccagcaggctgggatggtgttaaagcccacgtcctcctccttttcagctgtgtaggccacaccagagaacactgacacacccacagccaggtacagcagcaagatgcccacctcacggtagctgtgctgaaagagaatgtagaaagccaagtcagagtggatgggcttacagtcctggtattaggcatatggggaaactgaggcccagagagtataaaggacaggtccaaagtcagcaagatagagctggtgctaaggcccaggtcccctgactttaaactaagacctttcaactacagttggcagcaaaaccccctggtattgcgcacaggcctaagttctattgtccaaggtatctgctaggctacagctgttttttccaactccggggttactggtggcaccacagccagggaatgaagagcttgtgatttttacactgttgcagaaccaagagaaccatagtttatattccacaatgcaaagagttggtttcatgtacttttgactggtctgaaaagtataaaaatattttttgctcctccaggaagctgagaggacataagtcccctggaccacccacagaattcactttcctatggctgtgtatgtttgctttgtccctgaggccaagctctagggcagtgattctcaaacagggtggttttgcccaccacctccccgcctccaccccgcaagggacatttgggaacgtctagagacatttttggttgttgcaactgggacaggtgtgctactgccctctagtgggtaaaggccagggatactgctaaacatcctaaaatgtacagggcagctcccacatcaaagaattacctggtcccaaatgtcagtaatgcgaggctgagaacccctagtctaaagcagagtctctccaactttaatgcgtgcaggaatcatgcaggggtcttggcagaacgcaatcgcatagtcttgggtagagccagagaatctacatgtctagaaagcttccaagtgatgagaaagctgctggtggtcaggggcctcactttgagtagcaaggctctcatctggagtatattacacctgcatcttagaccctggcagctctgattagtaatactcttctcccctactgaagacaaagctagtagtgtcaggccctggctctctgcatggaggggacagggcagcgttctggggcacagggatcttccctggggagatgctgagctcagggggtctgctgaatgtaattccttatacctgcccactgccctaggattctgcctaggtcatctgccagcacccagtatcctgagggcatacaagaggctttactaagccatgggtggaagggatctttcttttagcattgtctggggattatcagtagggtcgcatggagctttaggagaaagaacatgaggtgctggagccaggcacaggtgggttcttctctgggttctactgcttattgaggaacctccaacaagcactgtcacctctgggagcctcagtttccacctctgcaaagcagtgacaataacccttacctctgtttaaacctctcacgagctctcctataccctcgggaccaagtccaaaatcatgtgccaagacttcatgacccttcggtgccctgccccgctcgactcttcaatttcatctctgggaatctccttccctccatgtcctcctcccagcattcatcctgttctctctccaggcctcggcacacgccgttcgccttgcctccctcttcaaaccatgctaatttcaccccccttgagtgcaagcttgccagggcagtgattcacccacaatgcagcacctggcacaaggaggatgctcagtaaactgcaaccaggctttacagagccaacccttcaacctcagcttcttcatctacgggaagagaataaataatagcatcttcctgaggaagttctcctaaggactaaattgataatggatgtgaaattggcacagatttagtgctcagtaagtgttagctcctggggctattcctagactttacctattaagagtgacctatggttatcagagccccctgatagtgccagaagaaaggctctagcagaaagccagttagcatcctgctttgcgcatctttgtgatatatataatttgatgtttgatagatatatcaaaagtgatctttgtcttttttcttcgttttgaaaaagaaagacaagcaaagctatgccccagttttctccccaggaaaaagagataacggtaagcccttcttcacagggctgttgggatagtcacactgcatgtgaaacgtacacctggtgtgcagccctgtgcctggcacaaaggacggcatctcagttgaacgttaagcctggactcggcaggcttgtaagttcacctgctaacctgccggatggctacacccgcccaccccagctccaacctggcctcagaggccgtaccttgagcgtggctcccagcgagcgcagcccggtggaatggcgcgccaacttgagtacgcggaagatgcgcatgaggcggaacacctgcaccaccttgcccaggtggccgaactccttgccgccctggtcgcccagtgccacaccagccagcagcgtgagatagaagggcagcacagacacaatgtcgatgaggttgagcgggtggcagaagaagttgcgcgtactgggcgccagcaggaggcgcgacgacacctcgaagctgaaccaggcgatgcagaagtactcgaggcgtcgcagcaccgggtcgtcgcgcacgccttccgggctgcggcccgcggccaccgcagccacggcggccgccgcctcgcgggcctggtactcgggcaggctgtggatgcacatggcggcgatggaggcgagcaccacgctgatggagacgcagctgaagagcttgctcggcagcgagtagcccgggttctccatggtcagccagaggcggcggcgcaggcggccacagcgcgccgcgccatagcgcgccagttctcgctgcacgtcggagatctcgtcggggcacgggtccacgctgctcggcgtgtcgctgtcctcgtcccaggcgtgcggctgggtcagccgcctctccaggtagcgcgcgcggcagcacgcggcaagcgcgttctcgcctaggccccagtagtcggcctcctggccaaaggcgaagacgcacagctcgtcgagcacgtgcaggtggccagtgcggtagaagtgcagcaggctcaggaagaagcccgggtgccggtcgaagtagaattcgcgcgccgcctcgtcgtagtcgtcgcacaggcgccgcgcctgctcctccgacgccgcggcctgcaggcggcccagccgcgtgcccgggaagcgcgccagggcgcgcgcgctcagctgccgccgcacgccacccacgttcacgcgcagcgcctcgtcgcttcgccgccagcggatcccggtgtcggggcccgggaactcgctcacaaaggtttcagtgctcctccctgcggacaccagaagggcgcgctgaggagttcccgggcttcccttcctggaagaccaggttaaaatcccctcctccatccaaccagccaaggggtgttggaggctgtgtgtgaagcatctggtatgcaggaggcgctcagtagatgtcaggtgccctctggactcagagtcaggcctggctttgactatccttcatccccatcatttgactttggccaaatcactgacccaccccacccccatttcatttttctcctttggaaagtaaatgctgagatctacctggaaggatatgaaagcgatggaatcgcaggatgtcctggcacctagtgggtgctcacataggatgtctccttttccaggacaaacttggatttatttacaccaaaggtctactgtgggatcttgggcccgccagccctctgaacctgtttcttctgcaaaatgaggatagtaacacttacctcctaggggtgttggcagcaccactttagaccggaggttctcatagtgtgttccccggaccagcagcatcagcatcacctgggaatttgtcaaagatgcaaattctcagcctgccatcgatttactgaatcgggaactctaagggtggggtctagcactttgtgttctaacaagattggaaagtgattcggctacatagtcaagtttgagagctcctgctttagattatgtaaagcatctgtagagtcagccagacctgaccttgaatcttgactctcttgtgtcaccttaggcaagtaacatcacctctctgagcctctgtgaaatggaaataaaaatattcacctcaaagtgtggttatgaagattaaatgacctagtgtctttcttgggcttggctcacagaaggaatttaataaattattcactggtgtcactatcttctggagtcaggcaaacctgggtttatctccacccctgacgcacctggggccttgaggaagctatttgtcctccaggtctcaatttcctgcacaacgtagataatagcacctacctccagggatgactggaggattaaggtagattatagaaagtgctcagccttagtggatactcaggaaggatttaggttcttccactacccactgactcctgactctgctggaattgggggctagtgacacctcctcaccactggcaatctcatttgcactgtgggttcagtaatgcctagactagggattaagtgtgtgtaaagcacctgggcttggcattaaatggatttggggttccacccttagctctatcacttgtgtgacctcaggccagtctccttcccactctgggctttagctcttttacctctagaatggggataatgttgctttggatgcatcattattgtggtatatgtcaaagccctgggaaaacagtagatgctcaataaatgttaatcctgtgtacttccctgtggtcagacctgagtctaccacttactagctgctgtccttgagtgcattcgtcgccctctctgggcttgtttccctgtctgtggaaccgggtagcatcatactttccaggagaggctcagagaattaaatgatgcaaggtgtttatcggcagcatggtccctggcacataatcaatgcacaataaacgtgtgatgtagctccgctcccacctccacttggatctccacctgcatttggcatcaaaaaatgaaatttctaatccagttccatcacccattagaagcataatattgggcaaatcccttcatccatcaggagctcactttcctgctctatgaaacaggataattaattcaacaaacattttctgacaagaacctgaatatcagtaagaaagaccaagtgacttgttcaaaatcacccagctagtccatggcacagctaaggttggagaccaggtttttttatttcattctctctccacacacttattttgagcacctcctatctgctagtcactcctctgggctccatgcacacctcactcggtttaatccctacaccaaccctgccagggaggttttctaatcccattttacagatgagcaaactgtaccagccagggtctccaaagcgcggccaccccacactgcttcctccttggcggggggtggggggtctcttagagggggtaagagcaccaggagccccaggcagccccgcctcccactctggctgcccgggaccgtcccggagccacgtccctccccaaaggaggccccttacctgtggtggcacctcccgggcgcctcgcgtgtctgtcccaaagccaccgaggctgggagccgctggctatactcggtctcgcctctgccccgccggccccgccgagcctcctgctgcaggcggccccgctgccctctccttccttcttccttgcctagtcccccgcggctgaaggccgcatcgatcgctgccggaggagggagtgaggccgctggcggccggaggcggcggtttctattcctgactcggctggggggtggtggtgtctggagactgggcctacctgcaggggcatcctccggagttacgggccgggaaggaggggtcatttagggcgtgaggattccccgtagagagggatttcagcagaagcttctctggcaaaggaacaacagtaatcatgatttacttaattgagtgtttagtatgtgccagggtacttcagctgctgcaagtgattgatctcagttattcctggcacacacacttgacagggccaggatcttatgtcgcccattttaggggtgagctccagtcattttctcagaccgtgggcatctgagttagggagctgtagaaggtggcctcatctcccttggagccccaggttcttcctaggtgagttgtgaagcttgaaacgatcattttacccctgaggcgcagtgtccttacctgcccacgggttcctgattcccacctgccaagtgggttgtgagggcagagaacatgtgccaaagagctttgtagaggttgtgaaatccccacacatgtacctgttgtgtggctgctgtgtgcctggttggggagaggctcctggagactagggcctggatatgagcctttgcacatattgttattaataataatgataattaccaacgtttattgagtacttaccttgggtcaagcacagacctcaatctcactcaaactgcaaatttatctgtggggtaagtgctactattattcctatctcacagataagaactgctttgagaggtgtggtgacttgccggaggtcccatggctgacttctgagtcctctaggccagcacagtccaacacctataatgtgagccacatatataattttattttattttatttttgattttttgagatagagtctcactcactctgttgcaggctggagtgcagtggcacaatcttggctcactgcaacctccgcctcctgggttcaagcgattctcctgcctcagcctcctgagtagctgggattacaggcatgcaccaccatgcccagctaatttttgtatttttagtacagaaggggtttcaccatgttggccaggctggtcttgaactcctggcctcaaatgatccacctgccttggcctcacaaaatgctgagattacaggcatgagccaccgcgtccggcccacatatgtccttttacatttctgattgcaacattttaaagaagtaaaaaacaggcgaaattacagttaccccttaaacagtgggggttagggaaaccactcctccatgcctagaaaattagaatataacttttgactcccctgaaacttaactagtaataacttactgttcgccagaaaccttaccaataatataaacagtcgattgacacataaatagtatctacatatatcttaggcattcacgacatatctaacttattcttaaggcttttgatatttctagtctacatggttcatctgtaagttttttcaaattgtcacaaatctccaaaaattttccaatgtatttattggaaaaaaatctgcatgtaagtggacactagcagttcaaactcgtgttgtttcaggatcaactgtatttttagtgatatattttattaaatctaaaatattatgatttcaacattggaatcagtaaagaaattattgagatattttacattttcttttttttgtactaagtctctaaaatccagtactaatttttcttattgctacataacaaattaccacaatttagtagcttaaaacaatacaaatttatgatctcatggtttctgtaggtcagaagtctgggcatggcctggctggaccctcagggtctcaccaggttgaagccaaggtgttggccagggttgaggttctcatgtgagcttcagagttttcttccaagctcacagattgttggcagaattcatttccttgtggttataggactgaggtctctcttttcctgttagctgtctccgagggatcaatctcagattctagaagctgccccataggcagttcatagcatgaatgcttgctttctttcagggacatcagagtgctgaattcctctcctgtaaccagccagagaaaaatctctggctttaaaactctcacctgattagtccaggcccacccagggcactctcccttctgccatataatatacattcacgggttccacctacacttaaagaggaggagattatacagggatgaggatcattgaggaggggtcatctgaattctgcctcccatatataaatctagtgtactaatttattttattttttattttttgagagagattttttgagatttatctatagcatatctcagtttggactagtcacattttatgtgctcggtagccacacatggctcgtggctgccatattagacagcacagccctaggctgtgccactttagtttttccctcgaaagaagaagttagagcaggaagctgcttagtgagcatcttgcccaattccctcatttgaccaacagggaaactgaggcagatttgccgagaagcaggtcttctgtttcctggcctaagagtttgtctgcagcctttgctacccctcaggactcaggagttttccctggagctgcagagacggtttccaaaattgagagaaaagacagacctatttcccaaaggcagaagagaatgaaaccaggatctggtttcatccccagattacacagtgagaggtaaatgaagttttggtggaatctgtgagccacaagagtgggaaggtgggccttatgggtgggaaggacggggcatccctgtccttcatgtaccatggatggtctgtcccccaaattctccctcagtccctgaccaggtttagtcattggaatccatggggttttaccttcagagtaagcttgattttgcagaaaatacagaaaattttggaattaagtagacctggatgtgacgggcatcttctaagatgtctcccagtgatgtcggcctcctggtgttcatgcccttgtgcaatcccctccccttgtgtgtggacaggccttactgagctgcttctaatgaacagaatatggcaaaagtgatgggatgtcacttctctgattaggttacttaaggttgtgacttccagctggctttgatgaaacaagttgccaggcgggaaaggtaagaaaatgaggaggacttccagccaacaaccagccaggagctgcggtattcacttcattagtcctcaaggaactgacattccgccaacaaccctgtgaatttgaaagtggatccttctctaattgaggctcagatgagactcccaccatggccgacccctcgagtgcagtctcgtgaagcagagaaactgaagcagaagacccagttaaactgtgcccgtgttcttgacccatagaaactgtgagataatacatgtgtgttgctttaagctgctgcatttgtgaaaccttgttacacagcaatagataatgaatacactgggttcgaatcctgcctttgccactaaactggtgtgtgaccttgggccaagcacttctcttggatctttatcttcctcatctgtaaaatgggaacaacacctacctttcaggattgagatgaggaccagcacatgctgttccctctccatgaacaactcctcctgccctttctttaccctgcatatcagttagaatttaacttagctgcgggaacagaaacggaattacagtgacttcactagagaagagtttactttttttttttttggcaggccagggtaggtacagctgctcatgaatagccctgaagacccaggctccttgtcacttcctcctccaccattcttatgtgactcattcgtgcccacagctcctctgggatcctttaccgcttttgtgcacacaggctcctggtatgtttttcctcctgacagctggtatctggggctttcctgaggctgccagagcctgctatggctccgcacagggagaacctgaagtacctgagaatgtatgtgctccatctatagaaacatttcttgtttctagaactgccctgtgggacttcactggatttcacatcctcactggcttcttctcttcctggtgaacttctgtactcctatagccatttttcctggaaacatttccaaagcatcactgtcatatgattcttcatctcaagatttattctgggggaacccaactaagacaatcctcaaggacaccagatggctgttctagtggcagcagccatgttccaggaaggacacagggtaaatggatgacagacaaaaggccaagtctatctccttagttaggaaaactatagcttgccatgtagccccgcctagtagatttttcttacttctgattggccagtcttgggtcacgtgatcattgtttggtgcaagggagcctggagaggaaacatatttttaaaattttaatttacctttaaaattgaaatatactgttcctatggtaaagtgcacaacagctgaatgatttttttgtaaataaatgtatgtatccattgtaactaccacccaggacaaaatatggaatgtcactggcactccaagagcctgggggtggggtggggcaaatatttctaaccagggacactgctattggtaaggaagaaggggagaatggataattacaagtgttctacttggctagctcctgctaaaactcaaggtcttgacctagatatcatcttcaggaagacttgcctggtttctaggctgagttaggtctctcctggcctcccatagcctcccagacctctctagtctggtatatgtcatgcaactctctagctagggctttgtctcatccactagtgcatgagttctgcgaagcacagcctaaagcctatattaagtgctcagcaaacatttattgaataagtgagggaggaaagcaaggttagagtctgcaaaaggaaccagcctcctaggagactttccagaaaggcagaggagacaggcagtacagatagagctgactgggttggagctgaactcagagatggcactgcatagaccagctcacagaactgctggaacagggagtgagttagccaggaagctgagcagggaatctagaatggactgtgtagatgctgctacctatagccagagaagccatggtctgtgacctgtcacctcttgccattccaaggacctagctcagaactcagagctccaggatagtcacagggctcttgacagccaagtcttaactggcttaactgggagcttcctgctgtgaccccctaattttcctcctgatgcctttgaggaaagaaacctagggcaataagctgtgtatcaacaggcttgggttccagttgtctagaattaagtctggtcacttaaccttcttaggtctttgtgatcttcatttttcagatatggacactgaatcttcaaatgggaggaatcttaagtgggagaaatcttcaaagaccgattgtaattaattagagtagtcaatagggatgtaaagtttatggttagactgcttggggttgaatcccagctctagtacttacaagttggacaactttggccaaattaacctctttgtgcttcagtttcctcatgtgtgaaatggggaaaagtaatgaagcctacccgataaggatatgaggatttcatgagattatacaagattatacatgtaaagtgattaaaatgatacctggtccatggcacatgatctgtaattgttagctgttgctgcctttattactttcaagggaggaatatggtatggtttaatcctggctacatcatttctcagctgggggtcttgggcaagtcacttatctcataaccactatttcttcactgtcaaatgggaatagcctttctcagggttatgggttggatgaatgaaatgatgtttaaaagtgggagatctgcagtagacgttcattacagactaataaccagaatctgaattagtcaagctcttactgtgataaatctgtgacaaacaacccttgaatctctgtgacttcttaccacaaatatttttttctctttggcaagtttgaggcttggctggtctggctcagcttcaggcttgccccaggtgtctctccagcaagacaagtggctccgggcaagctcttctcatggcagagggcagaagctctaagaagggtggaggtcaggtgaggtggctcacacctgtaatcccagcactttgggaggctgaggcaggcagattgcctgaggtcaggagttcaagaccagcctggccaacatggtgaa[137 bp omitted]ctgcactctagcctgggcaacaagagcgaaactccatctcaaaaaaaaaaaaaaaaaagaatggtggtgttttgtctttaaacaggctacactgtcactgccacccacatcccattagctaaaacaggtctcctcgcccagcccaagtcactggggcaggctgtacactctccctgagggaagccactgtaagcatggggtggggaggggaaagggacaattgtaggcaaataatccaatctacaatattacctgtgttaactatctgaagctatatgtatatggggaaactgaggcccagaaagaggaacagaaatatccaagtttgctcagagtcagtgactcccagatagttctccttcccctctccaagacctcagtctatatccatgtagttagcatttggtacttttgagtcaaccgttcaagcatttgaatcccatggtaagaacaaggagggtgaggaagtagaatcccttccatcttccgatggggcaaacagaagcccagagtgcagaaggatgacctgtcatcatactgcaaggtcaagagaacagggaaagaagaccaaggattcccaagtgtacctccacagtggaccgcccagtccctcagtcttgtgctggacacaagaggcccagcagatagagcagggaatttgccacctccttcctgggaggaaagtgggagagtcaggaatccagctgtctgggtccagggatatcccttgggatgactgtcattccctcattgaccccttctccccgcaagaaacacttgttaaaccctgactgcatactggacccaggagaaactgaggtgagtgaggtggagagagagccatcacaataatgacatcccgacgacttgagcaacatttccccaaattttgggcaatttgaagtgatcttagtatgtacctggatgcagtgtcacataacatggactcctggagggagaaagtcattcccttctcaattcttctgattacctcagggagaaagtctcagcttagacatttgcatcttttatttatttatttatttattttatttttttatttttatttttttttgagacggagtctcgctgtgtcacccaggctggggggcaatggtgcgatctccgctcactgcaagctccacctcctgggttcacgacattctcctgccttagcctcccgagtagctgggactacaggcgcccgccatcacgcccagttaattttttgtatttttagtagagacagggtttcaccgtgttagccaggatggtctccatctcctgacctcgtgatccgcctgcctcagcctcccaaagtgctggtatgacaggcgtgagccaccgtgcccggccgatgtttgcatctgtaaccctttaaaatcttcattgattaaaacatagactggccgtgcacggtggctcacatatgtaatcccagcactttgggaggctgaggcaggtggatcacttgaggccagtagcttgagaccagcctggccaacatggtgaaaacctgtctctactaaaaatacaaaaattagccaggcatggtggtgggcacctatagtctcaactacttgggaggctgaggcagaagaatcgcttgaacccgggagacggaggttgcagtgaaccaagatcgtgccactgcactccagcctgggcaacaggatgagactctgtctcaaaaaacaaaaaaccaaaaacatagagtgagtacaggcttcaggctcagtcttggcaggtggctgtagctagctagagtttaataacactatttaatatcatttaatctgacatgatttactttaatggaactgagctgtttccattgcatttgttttcataattccatttgtggtaattgatctcatttatagtagtgatatcaattttcttttgaaatgaatttatttatatacaaaagtgagccatttaaagaaaacattaagtaaatggtggtacaggcagcgtgcaacctatcatggtgctattttgtaggtatggtgaaaatcatgaaagaggtgaatgactgatgtttggaaaactctgcaagaatattcattctggatggttgggctgcctgagggagaggtcagggtctgcctgaattgggcatttttggtggaggaagcagcatgtacggattggtgtgaaagcgttaggaagggtgggaagctcgtatggcagtggtgcagagtactggggtgatacagaggccttcctccgagctcaggctatggactttgactcccaggaggagaaaccaggggtggatgggttgcagggaagtgtcagcaggccagtgattatcagaaggctggaaccaccgctggtagagatagtgctgtccagcgggcagggccccaggcctcccatcgtgaactctttccgttggtccccagcttaggtgcagagccacagatcctaaatcagaattagcctgaggagggagaaagaaagggttaattccttcccataatagggctctggtttctggccttggtctcccatccatgccccaccagctcagctctggttgccaccaaggcaggattcctctgcccccttcaaaagggcaaacagaagcccagagcagtttagggctgtcatccaggtgccacagcaagctcaagaagagaaccaaggactcccgggtcctctgtcatcctagcaggactcctccaacccctatccagtttcctaatcctggccatgggaggtcctgacttctggggaggcatcctgttaagcttgtagcaatgaagaaagtattagagctgggctcggagaggggaggcacctgccctgggcacccaggagccgtacctctggcaggatcccggcaatcccgcccgcaggcgctgtggcagcatcgctttttgcccgagcagtctgagtccttgtgacacaggtggttcatggggctgaggcagcgcagttggtcctctgggcagctgcccagcttcactgcaacacagggaactgggtgagctccgtccttgcccactggccctgaagcttggggcttggatggtcagcaaggtggaggggaggcatttaccagagaccctggggacacactggcggaagcaagctctgtagcagcacttcctggtcaagggacactggctgtcttccacgcactggtcaggcaccgataggaggcagggcccatcatctggcgggcagccccccgatttctctgtaagagaatctcctaatattgcagctggaggaagctcacggttatgtaataagcgctgacctgggaatgacaagactgaattctccatcccttgctttttgcctgtcttttggctagttgttatttttgtttgtttgtttgtttataatgactccaagcctcagttttctggctgtgaaatgggaagctgggctagtttgagactcagatggcacaaatgacaggggaaaatgaagcccaacatctccactgtggccaataaggccatgcctggtctgggccctgcccatctctctagccccatcctctactgccctcccactcagtgcctcctgatctgctccaagccagctctctctgcagggctcttgctcgggccgcatcctttgcctagtgcacttctcctgtactccatgcgcctggtcagctcattaggactcagcagaaacatcgcatcctcagaagaccctacttctctgaccccacattaactaggtcagcgcccccccaccccggcccccacacacacactcatttctttcctccagagtttgtgatgctgcatctgtttgtctgtgtctctcacttggctggaggtgaggagagtagacaccctgccagctttgctcaccgttggtccatatcacagcccttggcgcacagcagtagggctcagtgacttggaaagaaagggttttgaagtgaggcccagcattgcacgtgcgtcagcagtggccagcctggtgcactgtcacagccacagctggccacgtcttctgcaccgttgcgttcatcactgttgcaaatggcatggtttcgaggatcaggcgttaactctgtctctgaggcgttcctctgaatggtatagagtgtcctgtcccagagcttacctaacattcttcttgctgggattttgggccatgttcatatttcatgcacaaagctggaaatcagtatcctcctccatgtagaggaggaaatcaaggcctgaaaagggcagtgacttgtccagacccacatgggctgggcttaggactcccagggcccggctccctctgacctctgtgagtgtccaccctgagctgtctttgagctgtagggatggagcaggtcccaggtcttcaattcaatccagcatcagagaaaatgttcaagagttccgaggggcagctggatctggttctgtgactttacctctgtgtccgcccctccccctcagccccctgcctgggtgctggctgcacacataagtaggcaccttgctcacatcctacgtgcgctaagtcaacttcagctgtcacatcgggttggtttaaattaaattgctgccccctgctggagaaagagaggcttggcgtggggagggggaaaaagtgtgggtttggggtggtgggggtgatgggagggttcctgggaaactgtctgaggtccaaggtttagccctgaattcacaagtccaagtcaaaggtgcgcaggcctcaaagggtgggccaaacggagctgcgtgcactcaaagccggtggagccgggtgggtcaggcagggagagcttctgtggcgaggggcctggggctggccttggggaatggacagatagggatggggcatgacagctggcatttccagtggaagaactgcgatagctgcaatgtggaggtggggataaaagcctggcgtgtgcagagccggcgtgagaggctctgggtggtcacactcactctgtttgcctgcctttcctaacagtccctccaaaccaggttctccactcacagatgtgtacatcgagacagtcacacacacagatggtcatccagatgcatgcgccatgggtgtgtagacttagagagcaaaagaatcgtatccaaacatggttaaatatatacacttgtacacacagacgatacacacatagtcaaatacacaagcacatttagatctagacacacaattagctacaggcttaacagtaggaaactgcagatagtcaactgttttatctacaaaagtagcaattttacatggttcaacttaatacacacatatatacatatggacatatatcagagagttatatatatgcaatatatttataaacatatataaacaggcagtcatgtatgtacatatgagctggaacataatcactgtcatttacacatgcctacccacatagatacatacacacagatagacactcagacacacacagttatgtatataaatatataaatatatagcatatgtatgtgaacagagagacatacataagcatacacagtcatatatacagaatcatatgcacagagctacacagacacatatatcttcccaataccacataaccactgacagcatttaattaggcacttgctgtttatcagggactatgccaggctctttgtatcagagacacccagacgtttgagtgagaagggggcagaatggggagctcttataaacagaggcggctgggcttccacaggcaacaaactgagacttcccttcccttggcttcgtcaccttcctccattgtctgaaattctaccaacagctcggcaatgtcttacaggagagaaaccagtgggggacaaggtgtggtgaactgggggagagacaagcttgtcacacctgcccatgcagagtggccctgcgcaggctcggtttctgctgtgccagctctttgcctctgagcagctgggctgaatattggggtgtgctccctgggaacacaatgactcccccaaatcacccacttatgctgtgcttactgtgtgccaggcccttattcctcgagacaccatttactcctgagagagaggcatgggaccccattttacaaggagtaagtctccagacctgtcctgttgccttccaggagtgtcctgcctggaagtcctaataaactcatgcacttgccaatctggccttgtctaagtcattctttgttctctcagctccttcctatgttgggggtgcattgtcctgtacagtcctgggtttttgctgtaatagttggtaaagtgaatctttctgatttcaaatacttgcactcatgcacttgctaatctggccttgtctaagtcattctctggtctctcagctccttcctatgttgggggtgcattgtcctgtacagtcctgggtttttgctgtaatagttggtaaggtgaatctttctgatttcaaatacttgcattcaaatgccacatttggcactaactcagagtcagtctttgaccttgttaagtggttccccgctatgcctcaattttcctcatctgcaaaatggggatgaaaatagtcctgtcctcacagcaccttgtcgaggagttacgtgatgatggtgcatgaatcacagccaacacagggtccagccttggagctcaccagtgtacttccttcctcagcctgtccccattactgtcccctttctttaaggcagggcaagggttgcacaggtgaatgtaggttggagtgttccagccccagaaaaggacgcaggtggaggcctcacccagatcaggagtcacctgtctagccactcagcagccctccctcacctgtcagcaggccagccccagccttgtcaggggtgggaatggggacaggaggttgggggcgatgagagttagagacagagcttcctccccacaaagcccagatcccagaagccacaccctctcctcaattcccaagtcccttccacagatggggtggtggacccactgacccagtcacaccacagcccagcaggcacagacagggtccctccccacacctgaaggcacagagacacacatggacaggcaccaagctcagacacatgcgtgcagccattcctaagtgtacgtgtgcagacagagctttgcacagacaagcagacgcaaagacacatgtctacacagacacaggcacatgcattccccgccctgccaccccctgacatatagacaggcacagacaagcaccgagaaactggcagaaaagacacttacagataccaacacaggcaggtggacaggcacaaatgtacacacataaaaacacaggcttctgaaagcactaagaatcaggcatccacacatacacacacgcacgcacgcacacacacacgcgcacacacaccccacagggcattacctgccttcccccaaacccttactctccctagagaagtagagacaatctggtccccccagcagagggatttcccgcactcacctcccttcttcctgccaaagacagcaggcagctgactccccacagccaggagggcccccaggaggagaaggctctgggtcctcatatttctgctgccggctcagggcccagggccccccagattaacacctgcagcctcagggaagccagagaaacttagtcaggagaggaaagagagggggtgtggagtgacaccgtgcctgcttcatcttggccccaccccctgagggcccgaggactcagtgcaagggatgctgtcacaatagctgaagatagggtggcggcacatcctgcatgtgggggactcagatccagtcttgcctgtatcggtgacttgggctgtgatcttgggcaagtcttgtctctctgggcttcagttttttcatctgtacacagggtgaaggttgttgaggcagatgcttgctatcctggctctcaaagatgttgaagccccagcgatgtctaggcagcgggtagaggtcagctttgaatagcaaaggagtgggggtttgcagagttctggatgcctaggaagggagaaggcattagggttaggccagagcttgcagccaaagaaggctggcccaggctggcataatgagtgaggccagccctggcctctcctcttgggtcctgtggatgggagaaagaccaccccgcctttggtgagatcaccagtggcttctgatagaactgccctcttcctggggctggcttggctgttgagggtgggggagcatggcttttggcttggctaagtttgctggtcacagcagatgtgtggccactggaacctcttctctggccctaagggatcctgagcaaaaaaatgtcatctcatccagggacccccaccttagatttcgtatctctgatgttgcctcctgcatttggtagaagagagggagctgagacttggcatcctaagggacatcctaaacagaaactccatcgaagtacattctctcagccttctcatttgaaagacgaggaaactgtgagatagagatgagaggggactggcccaaggacacgcagctaattcctgactaagctgggacttcccactgtggcctccccatcaccctcattcagttcctgggttttaaaagcaggtcaatacctcatctgatcctgagaaaggagggtgatattacagggcttgtctcacttacccattccaatccaggacagccctggcagcaggaagttcttccttgggtttaatgtgaatctctcgtgctgtcttctaagctattaagataggagaggctctgtcttctatgatctgatgttgcttttggaatgctggcacctccttggaagctttattttggaggacaaatatatgagcccttccttcctccctccctccacccctccctccctccacccctccctccctctttctttcttttttcttttctttctttctttttctttttctttctttccttttttcatttctttcttctttctttccttctttcctctctttctttcctttctctttctttcttttctttctttcttctttctttttctttcttctttctttccttttttatttctttcttctttctttccttctttcctctctttctttcctttctccttctttctttctttctttctttctttctctccttctccttcttctttcctctctctctttctctttctctctctgtctttgacagaatgtcgctatgtcacccaggctggagtgcacagtgccatcatggctcactgaacccttgacctcatggacccaagtagtcctcctgcctcagcctcctgagtacctgggactataggcatgcgccccaatatttggctagtttttattttttgtagagatggggggtcttcctatgttgcctaggctggtctctaactctaggactcaagtgattctcccaccttggcctcccaaagtgctgggattccaggggtgagccactgtgctcagccatgaaatgctcttttttttttttttttttttttttttgagacggagtcttcctctgtcatccaggctggagtgcaatggggcaatctctgctcattgcaacctccgtctcctgggttctagcaattctctgcctcagcctcccaagtagctgggaccacaggcgcccgccaccatgcctggctaattttttgtatttttagtagagacggggtttcaccatgttggtcaggctggtcttaaactcctgaattcaggtgatccacccgcctcggcctcccaaagtgttgggattacaggcatgagccaccatgccaatgctttttaaattaaaattattttgtagacattttcctgtgctgtgaaatgttctctaaacatcatgttttctgatggctacatgctgttttgttagatctatatgtcaaaacatcacttcagtaaagtttttagggaaaaaagatatgccaaaatatacacaatcagtatcctattatgaaacatggaggtttccaattttccactttcataaataaagctgtgataaccatctttttgtgtacattttggagtcacatctctgactgttttcttaaagtaaatttgtcaaagttagaaatgctaggtcaaaaggcacagtcatgtttccaggcgttggatatatctggtcaaattaaatttcagaaaggaagtaagtgagtgtacaagagcctccacctgccctgccatagacctctattgtttcgtctgcccagcgtctcttcctttggtggaaccattgcctcctgactgctgtcattctggttggttgccaatcagcaggtacttctcctatcaaagctgagggcactggatccaggttacacccactgcactcttctccacccctaacttgcccacgccttcattagagtcttgaacagataagccagttctctaaacagaacagtccaaagctcagatgctgttgctcacagccaaagatccttagtggatattcttactacatacaggatattaaaaaaataagtaaataaaatctttgctaacggaaaacaatatttcattttaatttgtcttcctcttcctcttaatacccatgatggtgagcatttcttcatattcgcatactgactgtatcctttctctgtgaattgcctgtttttgtattttgctcatttttattgggggtccttttatttttgagttttaagagctgtttatatattaagaatctattaacctgtcatacacaaggggcagtagtgaacagatgtatattggagttaggcagacctagttttgaatcttggtgccataggctctatctgtttgacattaattttgtaaaacccctgtttatttttgtataccagtagagatagagataatcatatacgtgttataggatggttctgagaactgaatgagataaacttgataaatgctttgatgctatattgcaaatatttctttcctcatttttgcttagtaccaaaggattaaattttggggtaatcaattcaatcttttcattcatattttctccttttatttttatgctaaaaaggctttttgactctgatgttagataaatattcactatatttacttgttattattttgtgatttttgaaagacatgataattctttaatctagctgaagtttatcttggtatagagcgtgaaataggaaatatcttttttttgtaagtaattaagcaattgtcctatgatcatttagtgaataatttaaacttttgccattgattaagaattaaaactttatcaataacttaagtcttattgtaacaggggctgtttatgggttttcattttttttcttttccttttttttttttgagatggagtctcgctctgtcacccaggttggagtgcagtggcatgatcttgactcactgcaacctccacctctcgggttcaagcaattctcctgcctcagcctcctgagtagctgggattacaggcacatgccactacacccagctaatttttgtatttttagtagagacagggtttcaccatgttggtcaagctcctctcaatctcctgaccttgtgatctgcccgcttcagcctcacaaagtgctgggattacagacgtgagccaccgtgccttgcccgttcttttcttttgactgtttattcttatgccagcacagacaagcatgtattgtgggttcagttcctgaccactgaaataaagagaatattgcaataatatttggttagtttttattttttgtagagatgcggggggcgggggccttcctatgttgcccaggctggtctctaactcctggactcaagtgattctcccaccttggcctcccaaaatgctgggattaaagtgagccatgtggattttttggtttcccagtgtatctaaaagttatgtttgcactatagtgtagtctattaagtgcaaaatagcatttgtctaaaataagtatgtaccttaatttaaaaatactttattgctaaaatatgctaataatcatgtaagccttcagtgagtcatcatcatctttctgctggcggagggtcttaccttgatgttgaggctgctgaatgatcagggtagtggtttctgaaggataggttgactgtggcaattttaaaaaatcagacaactatgaagtttgctgcatccatggactcttcctttttttcaactttcattttagaattagggggtacatgtgcaggtgtgatacaaaggtatattgtgaaagatttctctgtcacatattgtgaaatactatcaaacatgcaatgctgtttgataatattttatacactgtacatcctctttcaaaatcagagtcatggcatggtgcagtggctcatgcctataatcccagagctttgggaagccaaggcaggagtatcacttgagcccaagagtttgagaccagcctgggcaatacagtgaggctctacctttacaaaaaattaaaaaattagctggatggtggtgcatgcctatatcctaccccctcggaaggctgaggtaagaggattgtttgagctcaagagttcaaggttacagtaagctgtgatcatgccactgcactccagtctgggcaacagagcaagaccctgtctctgaaaacaacaacaacaacaaacagttggaatcaattctctcaaaccctgctgtgttatcgactaagtttacataatactttaaattcttggttttgtcatttcagcaatgttcacagcatctttactaggggtagattctatctctcaaaactactttctttgcccatccgtaagaggcaacacctcatccattcaagttttatcataagattgtagcaattcagtcacatcttcaggctccactttaattctagttcttttgctatttccaccacatctgcagtgacgacttcctcaactgaagtcttgaacccctcaaagtcattcatgagggttgaaatcaacttcttccatactcctattcatgttgatattttgacctactcccatgaatcatgaatgttcttaatagcagttagactgtgagccctttccagaaggttttcagtttactttgcccagatccatcagaagaatcaccatctgtggcagctatgagatgtatttcttaaataatgtatagccttatgagatgtatttcttaaataataaaacttgaaagttaaaactactccttgatttgcagaatagatgttgtgttagcaggcatgaaaatattaattgtcttgtacatctctgtcagagctcttgggctatcaaatgcattgtcaataagtagaaatattacaaaaggaaagtagaaattgtttttttttgtgagcagtaggtcttaacggtgggcttaaaatattcagtaaactatgccgtaaatggatgtgctgtcatccaggctgtgttgttccacttatagagcacaggcagaatagatttagcataattcctaaaggctctaggatttttggaatagtaaatgagcattggctttaacttaaagtcaccaaatacactagtccctaataagagagtcagcctgtcctttgaagctttgaagccaagcattgacttctctctagctatgaaattcctaaatggcctcttctttcgataaaagactgtttcatctacattgaaaatctgttgtgtagcgtagccaccttcctcaattatcttgtgtagatcttctggagaacttgctgcagcttctccatcagcacttgctgctttactttacacttttatgttatggagatggcttctttccttaaatcttgtgaaccgacctctgctatcttcaaacttttcttacgcagcttcctcacctctcagctttcatagaattgaaaaaagttagggccttgctctggattaggctttggctaaggggatgctgtggctgttttgatttttttatccaaaccactaacattttctccatattaacaataagtctgtttcacttaccatttgtgtgtttgctggagtagctgttttaattgccttcaataacttttcctttgcattcataacttggctaactggtaaaagaggcctagctttggacctttcttggttttcaaacatgccttcctcactaaggttaatcatttctagctttttttgatttaaagtgagagacatgactcttcttttcacttaaacacttaaaggccactgtaagatgattaattggcctcatttcagcattgttgtgttccaagggagagaaacagagaatggccggttgggggagaaatcagaacatatgtgacatttatcgatcaaattcactgtcttatgtgggcacagtttatggcaccctgagacaattaggaaagtatcatcaaagatcactgatcacagaccaacataacagatgtaatgataatgaaaaaaattgaaatattgtgaatattaccaaaatgtgacacaaagacacatagtgagcacatgctataggaaacatgcagccaatgtacttgcttggtgcagggttgccacaaaccttcaatttgtaaaaaatgcaatgactgcaaagcacaataaaacaaggtatgcttgtattgtggctgtaattgttgtagctccataatatgttttagtgactggtggtatccattacccttcattagtctacattttcaattttccaggttacaagtattttattgttccatgtgaacctaatgatcattttgttaagttgcaaaaacaaacccttgtttttatcataaaatgttttcaaaaatgcacaaaagaacagcaaatacttttatggagcctacatacccatcatccagattcaacaatgaaccattttacaagaattccttcatgcatatccccaccccttttttggctgaagtattttaaagtaaatccaaccgatcttatactttacctttaaatacttcagtgtgcatctctaaaaactaaggacactttctcacataatgacaatcctactgttacacctaagaaaattaactgcagtttcttaacatcatctaatattctatttgcatcttgtttttcttattgtctcaaaagtgactctatggttgttggtgcacatattgcattggctgtaatgtatctgaagtttcttttaatctagaacaatctctccaactcttttttattctcctttcctccctccttcttcttcttcatgctattgacttgttgaacaaaacagacaaattgttctttagaatgtcccatgttgcttccctgtgatgtctttcatcttctttgtccttcacatttcccatagatgaatgctagctgtagaggcttggtgaggttcatgctcaactgtcttggcaggagcccttcttgaatgatgctgtgtgttttgtgttgcatcacctcaggaggaacggaggtccgctttacccatttttagcattgtggagacagattaatgtgttttcggtgtgtacctgaatcctcaagttgtaaacttgtgttttccctcttacaaactgtaaatataccacagggtgatgaaatggcaccctgtaaatattcagaagccatggataatcattgccagaatcaattatttcattagggtttgcaaaacccagtgggttttaattttaattatatttcaggtataaattatgctgaccaaggtgaacactttgaggaggcttcctgcttggggaagagcatatcttttaaaaaacatttatttatttattctgtagaaaagtttagtctatttatccagatcttttaaaatgtcatttaataaagttttagggtttcctttcagaaaatttctgtacatctctagatttatttgtaggtattttatattttattcactttgataatgttgaataggattttttttttttactattaggttgtcttagcaggtttgggctgctataacaaattaccatagactgggtggattataaacagcaaatatttatttcttacagttctagaggctgggaagtccaagatcaaggcaccagcagattcagcatctggtgaggaccagtttctcttctctgacagtgccttctagctgtgatcacacattgcagaagggcaaggcagctctttggggtctcttataagggcactggtttcattcatgaggggtccattcatgagcattagggaggagcaccaggtagagagggaaagtaccgtccctggggtctggactttttgtgactcttccctctttttggggaaaaggacttcaagctcaggttttctttggtggggttgggtattgcttcttccatattccaagtctcaggaccctcaggggcaggtgccaagtgagagtgacccccagaggtagaaaggacccagcatcatttctgaggacacctggtagaggaggagcctggacacttggcctcccatcctggctcagggtatggccttgacacatcttcatccttgtttcctcctttggacaatggagatgttcagactaggtggtctctgagggccctgccagctttagccatccctccccacaccagctaaagggactaattcctccgaactttcatgggtcagatagaggcagggaagggacagccccagccctgggaggcaggtctccttaccttcttccagttccttcacaggaatcacacacttgaagccacagtgcaggtaacaacacttcctttcccccagacagtcctggtctgtgtgacactggggaggatcggacttgaagcagcgtacgttgtcagctgggcaaacccctgctttctctatacctagtggaggaagccacaaggtgatatgagaactccagccccagagggcccctcaggacctctccccagcccagccccacccagctccaccatgtctgctcaccctctttaactccttccacagccaccagggtcacaagaacgagagacaccatgaggaccaagaagctgctggaccccatgttgccaggcaggtgcttggctgggagctgggctgagcctggctttatagtgttcctgctgggcatgccagtgggtggagctgaaggctcaaaatggcaagggaggctgcacttcccagctctatttggaaatggccccttctgaggagggacttggggctttccctaaggctctgcactggaatagatgaagaaatccaagagcgaccctcgttcttcacacgaggagaagaaatggacacgtgattgaccattaggcgccaccagggccaaactatcttatggaaggaggaaaagaagcacagaaagggcatgaaattactcaagttcacacacgaggcagtggcagggccagacttcctcaactccaccgtgttctctatcagtccctcttcatgcctgattcacctgggaccaaaatcttccctccttcctgtgctgccccggacttgttctcagttctcacctcaccccaaggaagaatctgaatggcagtgcttaaaatgtctgtcctgaacattcactctcagccttgcgctccagcaccgtgtgctcctgccccccgccaatctcatgtggcctggaggaaagcagattttggacctgtcaccagctgtgtgactttgaaagcagcttcacctttctaagcctccgtttcctcattcatacaatgagcataataattatactgtatcatcttcataggatttgttttccctcctctgcccctgcatcccccaaattcctggatttggaagaagacatggacgtgtgtgcgtgtgtgtgtgtgtgtgtgtgtgtgtgtgtgtgtgaccaggcttttggggtcctttctttgaatgagtactaaagggaggaaaatccttcctgttggaaaagttgcagatataagcccagaaactccagaaatttggtcctggccctggtgagagagaaattctgagaagataaatctaagatgctgataaaaagagatgagagatggacagggagtaatttagaggatatctagtccttcactaaactttttcctgagatcagccccactcatacccagggttatgttaccacccaatacattcacctttctgcctaagctggtctgaattggatttctgtcatttactaacaggacccctgagtaatgcaaagatttgggtttggggtgttccacatcctgaagtgtggaagggactgagttggggttaagtggaggcagggaggatacctccattcctggaagtgagcctactccttattaggtggtgaatctttggttacaatctcaccagtcatatcactggactcagatcatttggataccagggatggaatctgggaagttcataaacaaatactagaatgttggaatgtattggctatttcctcctccacctttttattatgaactttttaaacatacagaaaaattgaaataacagaacaatgatacttgtatacctacaactggatttaacaattattaatagtttgggatattttagaatacctatagctacatttgttgaaatatttgaaatgaaattgaatacattatgttcctatttcctaaatacatcagcatgcaaattctaagaataaggatattcttcaatataatcacaaagccattatcatatctaagataattaatagtttctgcatgtcatctcatagccagttcatatttgtttctccggttctccccaaaatgtcatttgtaattgactgttgatgatacttctttaaaaaaagtattgtaaaataaatcctacatatgaaagaatgtaatcaacattctataccttttgaaaaagaataataaacacctatgaacctatcaatttagaataggacattaccatccctacttcagaggtaaccactatcttgaactttctgttaatcatcctcatgttttcctttaaagttttgctctcttgctatggcttgcttagtgatacgtgttgtttaatttcgtgtaagcgtaattatggcctaagtattcttttgtattttgcatgctttgctcaacaccgtgtttttttaaaaaattgtggtaagaaatatatactataagacatgacctcttaacatatttttaagtgcatactaacagtattgttaattgtgggcacagtgtcatacagtaggtctctagaactttttcatcttgcatgactgaaacccactgaatagcaactccctattccccccacccccagacccttggaaccaccattctgttttctgcttctataagtgactactttagacacttcataaaagtggaattatgccatatttgtccttttgtgactggcttattttgcttagcataatgtccttgaggttcacccatgttgtagcatgagatagacttttcttcttttttatggctgaataatattccatggtatgcatatatatgtacatgtatataatctttttccttccctcatttatctgtcaatgggtcaatgcacatttaggtttccatttcttggctattgtgaatattgcagcaatgaacttgcaggtgcaaatatctctttgggatcctgatttaaattcttttggataaatacccagaagggggattgctggatcatgtgatagctctatttttaattttttgaagaacttccatactgttttccgtagtggctatactcctttaaattctcactgacagtgcacaagggttccaaattctccacattctcaccggtacttgttttctttttcttttctttttaaaataaaagccatcctaacaggtatgaggtgatcttatggtttgattttcattttcctgatgattagacatgttgagtatcttttcacatacctgttggccatttgtatatcttctttggagaaatgtctgtttaagtcttattcacttttaattgggtctttatatttatatgtgtgtgtatatatatatatatatgcatatgtacacacacatatatataatgaaaaagaaaagaaataagtattagaatgggagacgagaaaagccattgtttgcaaatgatgcaataataaaaacacaaaagaaactacagatacatcatgagttagacaatttttcaagattagctgacacaaaaatcaatatataaaagtcagctgctttctatacactagaaatattggttagaaaaatgtaatacgttaaaagcaataacatgtaaaatatttagtaataaaggcaacctgtgagatgggaaaaatatttgcaaactacctaccagataaggggttaattttcaaaatatataaagaactgcaactcaatagcaaaaatatgtttacatatatatatacatatatacatagcaaaaatatgtttatatatgtatatatataaatacatttaggcttacatttaggtttcctagaaacctagactgtctaggaagcaagccccataaggaacttctcatattcatattataagaaggtaaaattgcaggggacaatgttcctgttttgtagtagtaaactaccttctcaaaaggtggttattttgtccccaggggactttggcaatgtctggagacatatttgattgtcacaactgggacagatgtgcttctcacatccagtgtctagaggctgaggttgctgctaaatatctaacaatgcacaagacagcttttcacaacaaacaatgatctgtctccaagtgccaatagtattgatgttgagaaacgctgctgtcctgcctcactgactaatagctgtgcatggcctcagaacacctcaatgtaggctgaagcgagtaatgatgggagtgtctgctgggagtatcccatgcttaggagtgctgatccttggctcactggtttcacccagtaaaggcattccttagcccatgccatgtgaccttgtggaattcatcccatgttctgctgaatcaggttaataaagttcccttttaattctagttagctaagagtttttctcatgaaaggatgttgaatttttatcaaatgccttttcttcatcaattgaaataaatatatggattgtctcttcaatctgttattttgtgaattacattaaccagatttcacattcattgtcttttttgggcatcatttatttatgtgcttcaagaaagtggaaagccttgaaccaaaatggcggagtctaagacagggaatgaaagggaagatatatttctcataaacgtggaatatatattcctgaaaatcattaggttacagagttttgctcactacaaataatagggcttctggaaaaaatagagttgaagtagaacattcaatatttgtgcagtctcataagtaatacatcaaacaaacagaacccacacccaataaaaacatgaccacagtgttaaacatcttcagttcctaataaagaaattatgtagtaaatgtagcactttactttgacaaaagatggggagtttgcttggtaagtgggtatggtgaaatactgtggcttttgaggtatgtacaaaaggtggaatgaaggacatcatcattcttgggactaaatgttgttatactggagggtcattgtcgtcaatcttttacttctgtactggcttaaaacagcaatccgcttcgttgatttgccagttcctcccttttgtaaggaagctgtataactctaaatgaaactggataactgcaaagttctatgctgatgctcttgacattaaaatcttgatctttggctgggcgtggtggctcacgcctgtactcccagaactttgggaggccaagccgggcggatcacttgaggtcaggagttcaagacaagccagccaacatggtgaa[133 bp omitted]accactgcactccagcctggacaacagagcgagactttgtctcaaaaaaacaaaaaacaaaacaaaacaaaaaaacttgacctttaatccactacaattgtttatcaatatcacttgaagctgatagtaactgatgtgttaggctcactagcggtctcatctctgacggagtgcaacatttagcttattgctgtggtgaatagcatatgctctcatttattcaaaaatattttattatttcaaacttctcagtatttaagacatttcttttatttatttatttttacatttttattaatttatttttttagatggagtctccctttgtcacccaggctggagtgcagtggtgcaatctctgctcactgcaacctctgcttcctgggttcaagagattctcctgcctcaagctcccaagtagctggggctacaagctggctaacttttgtatttttagtagagatggggtttcaccatcttggctagtctgctctcaaactcctgatctcaggtgatccacccccgtcagcctcccaaagtgctgggaatacaggcatgagccacaatgcctggccttcaggcatttcttttaaaatcatgtttcagattcttgtttccaggacattgaacacagtattaaatacttctatcaagaagaggatagaactcaggataacagcacatcacgcacttggtagggcaatgactataggtaaactgagataagagggaggagatgaagtgtttgttattttgtgtgtcactcaagagataccatgttcaatatttttgcattcgatttgttttatatgacaggacaaggcatagtcaccttatgaaaaactgtattaacccaattttacatgttagtgatttaattccttatttatctaccatgtatgaacatattctgcttgttaaagcacttgcttcagcaggagagactcgtgggtgtgtgtgtgtgtgtgtgtgtctgtgtgtgtgtatatctttatattaatgagaggtgacatcacagtaatctttgccttgacagtgtgcctgactgaatagtataagctgaattaatgcccttgttagaaattgtgggatcccaaaatatttaatgcctaaaaatcaggaaatgatcatctgaaccccttctccaccttccactgagccagacaaaggtgcaaatgcttccttaaaggaagatcaaccaggaagaagttatgcctattctttagctactttttccctagttttaaagatatgaaattctatttaaagtattatcacaataatatatgtacacagtataaaatgtaaagtgtaaaaccaggtttacaatgggaatctcctacattgctcctatttaccttgattcctgatacccagaggtcctgataccagaggtaaacacttttagctcttctagctgtttctaatatttatctccatgtttctaaataacattctgatgtattattaatgttcttacatttgtattctaaattgtgtattatataattttcttaaatttctgaaaaatttaaatttggatttaaaaaaattattttcttgtggtaagaacacttagcatgagatctaccctcgtaacacctttttaagtgtgtagtaccatattaactctaggcactatgttgtacagcagatctctagaactttttcatcttgcataactgaaactttacccactgaacaacaatcccccatttcccccttcctgaaacccttggaaaccaccatcatactttttgcttaaataagtttgactactttagacaactcacgtaagattataaaagtggaactgtgaaatagttgtccttctgtgactggcttattttgcttagcatagtgtcttcaaggttcatccacgttgtagcataatgaaaagatttccctcttttttggctattcaaattccatgatatgtaaataccacattttctttaccgcattcacctgtcaataaacttttagtttgtttccacctcctggccattgtgaataatactgcagtaaacatgggagtgatcaaggatgttggtaaacatcccagaacgtaccagacagcctcccacaacaaaaaaattgtccatccccaatgtcaatagtgccaaggttgggactctctgtcctaatccaagctattgcagtatttcttatctgggtcacagaaataacttgataactcgtcttcccactgacaaaccacacattctccagaatgatcacataaaacacatattagttcttgagtgtttgctgtttgactttatcatattctattccatctcaaggcttctgtaaatacaggtccctttgctggaacatgtcttcttcttcacctcttgctctttgaccacaacttggctaagtttttcatattcttcaagtctcagcttccatgatgctacatcaaagaagtctttttcaccctcccttttaatttttctcagagcagatagttttatgcatagtttatttatatttgtactcaaatttgccacagtttgtaatgacgtatgtatctgtgattttctttagtcgagagaaaattgtcaaaattattttccatcactcctgataccttaatgtgtatttccctcaaagatatcctctgttgtgaccacaatacaaccatgaacatcaggaaattaacactgatacattcttgtcctctaatagccccaactcaagttttaccatcataatgagaatacttaaaatctactatcttagcagttttcaaaagtacacaatattgttattaaccatattcatcatgctgtacaattgatatcttgaatttattcttcctatctaactgaaattttgtattctttgaccaacatctccccacactccccttccccccagcccctgctaatcacaatctattctcttcttttatgagttcaactttttagattccacatataagtgagatcatgcagaatgtgtctttctgtgcctagcttatttcatttaacataatgccatccaggttcatccatttgtaacatatgacaaagttttgttctttttttaaggctaaagagtatttcattgtgtatatatacattctcttgatctattcatccatttttgcatgcttatgttgattccatattttagctattgtgaaaaatactgcaatgaacatggaagtgcagatatctcttcaaaatactgattttaattcctttggatatgtaactagtagtgggattgctggattatattttagttctatttttaattatttgaagaacttccatagtattttccataatgactgtaaaaatttacattcccaccagtagtgtgcaaaggctccccttttctccacatccttgccagcatttatcttttgtcttttatatagtagccattctaacaggtatcaaacaatatcattgtggtttgtttgcattttctgatgatcagtgatgttgatcgttttcaaatatacttatgggttatttgtatgtattctattgaaaatatctattcagattctttattcactccttaattgggttatattttttctattgagttgtctgagtttcttatatattttagatattaatcccctatcagatgcatggtttgcaaataatttctcccacttcataagttgtctcttcaatctgttgtttccttttttgtgcagaagcttgttagtttgatgtaatttcatttgtctatttttgctcttattgcctatatttttggggccatatccaaaatataattgcccagaccaatgctgtggacctttcccactatatttttttctagtagctttacagtttcaagtctttaagtctttaacccactttgttgatttttacatgtggtgtgtgataagggtccaattttagtcttctgcatatggatatccagctttgccaacattattactgaagagactgtctcttccccattgtgtatttttggcatctttgtcaaaactcagttgactgtaaatgcatggatttatttctgggatgtctattttgtttgttctattggcctatgtgtctatttttatgccagtaccatcttattttgattactatggctttgtagtgtattttgaaatcaggtagtgtgatgcctcctgacaaaaaaaattgtcacttttgctcaagattgctttgttaaagcagtctttaacgaaaggtcttttgtggttccctgtaaattttagggccttttatttctagttctatgaaaatatccttggaattttgataggcatttcattgaatctgtagattgctttgagtagtatggacattttaacaatataaattctttaatccataaacataaaataatatttgtatttactgtgtcttcttcaaaccgataacttaactttgatcatatgaaaactctacactttgattccaccctgtcccagctttttaaaagatggggtcttgctacattgcccaggcttgtctcaaagtcctgggctcaagtgattttcctgcttcagtctcctgagtagctgggattataggcatgagctactgtccctggctcccacattaaaaatttttaatgttacaacttacatctttttatattgtgtgctctttgacaagttattgtagcttttattatttttaatagttttgtgttttacccttaatactaaaaatatttgatttacacgccaccattatagtattagagtattctgaatttgactatgtacttacttttattagtgagttttatactttcgtatgttttcatcttacttattaaaatctttttctttctgcttgatgaacttcctttagcattttttgtaatactagtctcttgacaataaagtcctccagcttttgtttgtctggacaattttagtttctctttcattcctgaaggacagttactttttttccttcagcactgtgaatatatcattccactttcctggtctttaaagtttctgctgcaaagttcactgttagccttattggaattcccttatgtgaagtgcttttgcttgctgcttttaggatcctctctctgcttttgatttttgacagactgattgtaatctatcttgttgtagtgttgtttggtttaaattttattgaaagcttttgaccttcctatacctatatatttatgtcctttcccagatttggaaagttttctgctattatttatttaaataagctttctacccctttttgtctcttcttcttaaaatcccataactcgaatatttgctcttttgatgctgtcctagatatttcataatctttcttcactactcttcattttttttcttttttctcatttgagtgtatattctaaaataacttttctttgagtttacaggttttttcttctgcttgatcaattctgctgctgatgctctttattgaatttttaatttcattcattgcatttttcagctgcagaatgtctgtttgatcttttaaaaaatggctttactctctctattaaatttcttatttactttttctgatttcatgaattatttctctgtattagtattattttttgaagttcatcaagcttcctaagaataattagtttgaatcccttgtcagacagtattatatttctccacttctttgaggtcagttattaggagattattgtgttcttttggtggcattatatctctttaatttttcatatttcttgttcccttatgttactatctgtgcatttgaagaagtagggacttattccaggcttttcagactgactttgtctgggagagcccttccccagtcaatctgtccagagattctggggagaccattgagtgtggtctttgggcaggtttgagtgcttgggcagcctagcctggtgcctgggtcagcaggtgggtggacgtgttacctgggtggggttgggcctggaatctgtattcacaggagctagcctgaagcctgggtccatgggggctggcttgctcttggggtggcccttgagcctgagtctgaaagggctggccaagtactgagatgagcctgaaacgtgggtctactggagcaggcctgtagccttagtccaaggggccgggcctgggtcctgggtccatggtgtctgaccttgagcatgggtcttcagggatggtactggatcctcagtgcatggggaactggcctggtatttgggtctactgggatgggcctggatcctgggtctgttagggcaatcctggaccctttgtcttctggactctgagaacacagagtctggtctagagtctgggtttggcctcatgttgtggcagttgtagttcctgggtctgcaggggcttgtctggatcctggcattgcagatgctggccagtttcctggagacgtgtgtgctggcttagagcccgggtctgtggggacctgcctggagcctgagtttactggggctgaccttgggggctgggtgtgtgggtgctggcctggaggctaggttcacaagggttgtcctgggtcctggccataggggctagcctggagcctgagtctctgggggccagtctagtgctgcggtctactgagataggctggaccctgggtctactagggtttggggccatagggaacatcatggtactggctcagagacagctagggacagtacttttgcctcagagatcactgaaattattcaaactggccaatcttgagacacttaccctgcctcacctgctccttcttgcaggaaccacagaaaaggtttgcccacatttctccctcactccctctatctcttgactgaaaaaggtgctttctatgtgcccccctgccctacccttcccatggcaaggtgtggctctcctttgagatatgtgagtataacaaactctcttttaaaaggcagtaatctcctgatatgttcgctttgtcatacctaaataatattaaatacctaaataatattaaaacccaattttttaaaaaggagcttggaaggcaaaggactagaaaatcagtagcaaggatgtctgtggtagggaaagaggaccaaaatgtgaggagacatttactgtgaagacttgtgtattacatattaacacctgctgggaagcatctatgatagattagaccctgacagccaagatgaaaaactcaacaagttgacattaaccagctttcttttttctttttttctttctttctttcttttttttttttttttgcgacagggtctagctctgtcgcccaggttggaatgcagaggtgcggtctccccttactgcaacctctgacttccaggctcaagccatcctcccacgtcagcctcccaagtagctgggataactagccttcatcaccatacctggagaagtaactgcaacacaaggtagaggacagtggtgagcatggaaatgcactgcttagatctcctgctgcttcagggtgtgcaactgatggatgcccccagctactgtcctctgcatctgccactatgtctgtgcagaagtcatggatgcttccatcaggttactcccagccaatgactgagtgaggcccgaacactaaggcaggctcattctgagacctgggcctcttctgataggtgacttcagttcaagcgttgtctttcagcctgactggcactttaccaatgttgtaattcattctgagactcttcctccttccttctctcctccctcagagcaggcagccctgcatcatggtctcatgctctccttgccactttggctacctccctttgtccctcacaggcattttccctgacacacactcttgattacctaatcctgtctaggtatctgcttttcagagtgagtcctaaacaaacctactcacctatagttttggtttgaatagttcaggaaatgttgaaaaaagggagaagaagaggaagaagatgggagaaaagaacatgctttttttttccttaatagttattactatcaagtcaagatgattaaattccgttagaaacattaaaaagattaaggttgctttttaaatgaaaggacaatattcatcatattcttaaaagtttattctttgtaactattatgcaattatgataaaaatgttagatgtcaacttaaagcatgctagggaataattggcttttcaaaatttgtttataatagttacaaataaaattttggaagacttgtccagacttctactacctttgtggtccttaactaaatgtgaaatattaatcatatccttttttcagatcctaagggaaaagccataaaggatggagagagagacagggagagagagaggagatccagcagtcttacagatttttctgtggttttaaatatacaatgctttatctctttgtcttcttgtcatattaacaagcatttaactctgaaatgacatcttgggcctgggaagatcatggacaaattggagaccagttatccaaatcagagcctgtagcaccagcgtctcctcaggcttggctaaggagtttccacctcgagagagaagagagaatcagggatgtaggaaggtgaaaaggttcagggaaggttcagcctggctggtactttgtcaatgccaggtgacatggcattgcaggagacatgaatttgtgtcctggggcactgtggcagaaatcctgctaagtactctccttcacagaaaactgagatatgctgccccagaatcagggactggggatcagggactctaggcaagccatcctaaggaataatgaatttataatccctgaccttacaatttaaatatgaagagaaaggtgctgtgaaaggtatcgtgaaaaactaaaataataacaataaaaattcaataacccttgagcaacttagagattatcttgtccaaatgtccccttcatacagaagagaagggtgatgccccttatgtgaaatggacagtgcatatcctgagcaaggaggtctattgagccacccgcttcactgttccgaggcagatctgtgggccaacccaacttgaaagatctgatctcaatgatttccaggggcatgggcagttatcaactccttctaagatgaatgcttctgcaggaaggtttcaggcgcagccgagaagggcagatctggggctccttacctcaatccaaagtccaccaaagctctgtacactgatgttgacagttgaagaagcaatacttctcgatccccaggcaggctttatagtgcagcacacaggtaagagggtgaaagggcaggatagagtaaactctgggcaatatccaggtttcggtgcagctggagaaagatgccacagggtgagtcgagggcaaccataagtcacttccaggtatcagggccagctcgttccacggattcctcagaggaaatgttccctaaccccacccacacccaggattgtcacgccttactcactcacactcttcaggattccaggctgaaccatgcggaggccaaagaggacggtcacagagagtagagagaggctgctcagcttcttggtgcaagaaaagggcgtgggtgcacctggaggctggacgagtctatgtcagttctggcggggctccaccagcaggcggcgctgtggctctgggggctggaggtcagaggtgcctcaacttgacccggaaccatcagctgtttcctttcacctccaggaagagataacgtgaaaccatttgtgcggtataatttatgagagccctcgtggactgcctttcttcagggtgttgcagggctgccctggctcttccttattctgactttatccagcggcttttgaggcaataggagggcattgtctttccccaggcttgtatcaggtctgaccaactcccctcgtcccagtgtgtatccagaacaattgaaacccacccctcccagcggtgttcacatatgggtgcgtttggggtaccacatcgaagttgaaacacacacaaagctagatattgtgctatcagtaagataatttctagattcatagaaaatataaatgcattatgaactacagagaaataagtttcagttgcgttattagtgtttgctcctttaactcctgtctttatgttgccatgactctgcaaaaactttatttgttgataaaattaaaagtctaactaggttattttgtaatgtgacccctaggctaaataaccgttctgcctctctgcactcctgtaaaagtgtgtgatgtacctactcacttggtggctgagaacatagctatcagtaatggtgagaaatgggttatgagtgcacacaggaaaattggtacctgatgtggaaggtagagaaatactgaggaaaaagctctctgaagcaggtgttctatctatctatctatctgtctatctatctatctatctatctatctatctatctatctatcatctgtctatcatcaacatcatcatcatcatcctttcctctctttctagtgcaatctgtggttacctcctagctgtgtgtctttttgctgttttatgacacaaagctggaaagttgatatatctttgaggtaggacagtaaaggtatattgctggccttgccagctgaaggcaaattgcttctggtgggccttatggacaggaatggaggaaaaggcatttgccaagtcaatggctgtacaccaggtaccaggaaatgtgttaatttgctcaagcaatgaaaccatatctggtacagcagctgcaattggcgtcaccacttggttaagcttatgataatccactgtcagtctttaagatccatctgtgttctgcccaggccaagtgggagagttgatcggggacgtagagggaatcaccactcttgggtctttcaagtccttgaaagtggcgctaatctcggtaatccctccagggatgtggtattgtttttgatttaccattttcctaggtagaggtagctctaatggcttccactggcctttcccaccataatagccctcaccctaccagtcagggagccaatgtgggggttctgccagctgttaagtatggctatgccaattacgcattctggcactggggaaatgaccacaggatgagtccaggggcccactggacccactataagttggacctgagccaaaactccgttaattacctgatctccataagcccttacttttggtcctggaggaccacaatgatgttttgggtcccctggaatcaacgtcagctcagagccagtgtccagtagtccctgaaatgtctgatcatttccctttccccagtacacagttcccctggtaaaaagccagaggtctccttgggaaaggatgggaaaaagattcactgcataaattggtcatagggtagtggggtctttcctcaaggggccctggcctccccttcattcaaggggttctgggtctgtaaactggttcaagtctggaaattgattgaggggccatgattctctgcttttataattcaaattagtcttttgtccattcgacctagaagttttatgcttgtataaattaaataggaatgcagtaggcctcctatcaatttcactttttaggaacactaggattaattagccagtgccagagctctacatgagtcagactgattgctgctttgcctctgctttccattatggtagctacacccaccttgcctttgacagttgagtgctgccacttggctcctgccacctcgggcttcagttattcccattgtatttaagttttgtagttaagtgactgcggttcccactgttagatctgacatacagaaaagagcaaatacagggctcttcaaagatgagggtgctgacctcacaaatcgatttcacaaggcattggtcaagggtgtatcttctggaccctcccagctgggatgagtaggtctaaagtgactaattcgctccagcatcccaatctccctaagcctttggatcccttcctctacattaagccaagggagatcaggcatttccagctcattcacagtgggccatcttttaatccatatttcagctaaacaagcaaataaactattagaaccttttaaaactccctgagctgcaacattaaatgcagagtccctacttagtgggcctaaataaagaaattcagcctgatccaactctatgttccttccaccattatcccacacccctaatatccatgtccatgcctgttctccagatttctgcttatataaatgagaaaactcaagcaattctttttgagtgtagtgcatctcctcatgggtcacactctcaacctcacctctaggggcctgctgggactttagtctacttatagttctagaagcaaacaggggtgttgggggtggctcctgaggagaatcaacattatcttgcctggcaactgcctcaggggaggccatcactgttgtctcaggcagcacagggtttatctccccagacaaaggtggaaaggctgatggcagcacaggtcagcgaggtgatgttgccactactggggatgaggaagctgtttcttctggcaaaaaaaggttcatcagagtttacaaactcagtgtcctcagcttcatcagggtcctcccacatgtccccattccaagttgcagggtcccattcttttccaatcaatgacacctggcgaggctgtgcatgcaccttttgttgcaggtcagccactcacatgataagagcttgtgtctgtttttccacaatttcagctctttctctaaaggagataagactctcagtcagggcaatcttagcagatttgagactcagtatctgcttctgaagctgggagatagaatccctgagttcatcattttctttcatcacttcgtccactgaacttaggagcaaccaaccagcttcattatgttccttggttctccacatatggtcaaaggtattatgtatagagtcactaaactccttgcctctcacaagcagtgaatcaggagtgtcaaatgtgcttattttgcataactctctaaacagttaatgccaaggactatcagtgttctccatactactattagaactagagtccttagaattttttgttctaatcatattaagcagcaaactccagaaaccccaaaccaatgaaagaactccatttttaatattctgttcctctagaaccactcttggtaccaaaatctgtattagtcagggttctctagagggacatacctaataggaggtatgtatatatatatatatatggagtaactcacatgattgcaaggtcccacaataggccatctgcgagctaaggagcaaggagagccagtccaagtcccaaaactaaagaacttggagtctgatgttcaaaggcaggaagcatccagcatgggagaaagatgtaggctgggagactaggccagtctagtcttttcacatttttctgcctgctttatattacagccacacaggcagctgattagttggtgcccacccagattaagggtgggtctgcctttcctagcccactgactcaaatgttaatcaaatgttaatctcctttggcaacaccctcaaagacacacccaggatcaatactttgcatccttcaatccaatcaagttgacactatgtattaaccatcacagtagtttcatagaaatagcattgaatctgtaaattgctttgggcattatggccattttaacaatattgattctttctttccatgagtatgaaatgtttttccatctgtttgtgtaaactctgatttcgttcagcagtgttttgtcataattgtagtagagatgttttacctttctggttagttgtattcctaggtattttattttatttttgtggcaattgtgaatgggattgcattcttagtttggcactcaggttggacattgttggcgtacagaaatgctacttacttttgtacattgattttgtatatcatacaggagctagggcctgccacaggggcctcacagttctgcctggtgccctatactactgtggctgagctggcacccaagttgcaagacaaagtcctcttaactcgtccctctcctcttgtcaagcagaagaaagggatctctttcagagctgtgtgctgcactgcctggggttgagggagggtgatgcaagcactccttcagctgcccaggctggtgcctcactaggtcgcatgcaccccatgtccactggcctctgagcccagcacagcactaggatttgtccaggagttgtagtccttgtggcctagacggcctttcaagtttatttagtagcccatagcactttagcctgcagtggcgaggcttgccaaaactcaagttccaactgctggaatgggtgattgtcctctggctaagggtcatctaaatgcgccctccgtgggcatcggctgagttatttctggtgttgacagcactgagttccaatgcagagtcccacaagcactgagctctccctctcccagtgcacgtattttctctctgtgccatgcagcctctgccgggggatgaggagggggttggcgtcagcaattcaagactctttcatatcctctacagtgtctctttcagcgatatgaagttagatccaggtattgagattactcacctgattttctgttttttatgaaggtattctttttgtgtaagtagttgttatatttggtgttcctataggggggatgatccatggaggcttctatttggctgcctttctctgtctccaaccttctgtttgttttcgtttttaaaaacatataaacagtttgtgctcaattataaattttcccctgatccatggaatgtattcacttaattatttgtttgggtatgtgaaacttccaacatggttccagagtcaggtctatgcataaaggtatattcagagaagaatcaggtatccatctccattctctctctactttctacaccattcctgacaacaccctgtaggtgatcactctcatggtctcttggttttttcctttgtgtgtttcttttttcctgcattgagtagaaaaatgaatattttcttcttttgctttatttattaaagacactttcactttataatgtatctagaaatcatacctcagtttatagccatcttcaccattcctctgaacagctgcataatactttgttgtatagatgtactattaacaccatttactcaatgactctccactgtataggcgtgtgggctgttttcaatactttgcagttacaaacaatgctgcaattaatacatttactttaattttccccattggggcttggattgtcttattggtctggcattcttactgtaactctttcaaccagggacaacctaagctgatcggtgaatatcttttgtgaaagacctctgtatcctcctgtcttggttgacaacctgtggaaagaaaaatgatttgaaatcatcacagatcttttcaattccaagctctgttctggactccaaaataattttcccatctgtatgaggagggcagttttctaggatatgtcagcagggatttcattctaaattcaatgggaggttgtggctcagggcatctgttacaagctggaaagaacctggagcctatctggcccctaggcactctgcaatcctggggtcagatacacatggctggctagaacagagtctgcaagtggctccagtgtgcctgaggtcatcagtgatgctcactgctctacccctgaaatgtacccagagcctggagagacgctatctgggctccttatcacagaaaaactttgtagtgctgaggtctctaggtcttcagtggaggagggtggtgtcagttgagttgtgcctaaaaccacactttctgacttctctacttacaagtcacactgaacatcgcagctgccttttctgggtaatctctaacattttttttaaaaatggaaacctttatctttgtttcctttttttcatttctccccaacaaagaagccaaggttgcccgaatggggccatcagtctccgtacaatcaagaagtaacacagtcaggattgctcagagggccccacgaatctcaaatcccttatttttctgttgtttttttttcccccagaaggtaatttcagctttagaaatggacagagactgtccaaaatcctatatcaggttggtagcacagatggggctacaacaaaatctgtggaaggaaaacacaaagtttttctttccctgggacccaagatgtaatgaaggtggctattgtaaacaagtttcattcttggcttctaagtgtaataatttcattcctattttggggaaattaactaccatataagccctggaagccagaggctgtgccactttttataacagagcgggaaaatctggatgcttgttttctctgcctccactgagagacaacctcatatgagcacatgctgggttaatgtcatatgatgcacaaactctaaactggacttgggagctaatgataataggatgtgaacatttattcctgggacatttatagcaatggcagctgtatttgacttttcagaagagaaatggaaatgatggtagagacattggctgtgagacatgtaacctccacctgctttcaggtatcaccagtgagctccactaaggccagtatctggctgattttgactgtgattctgcattcatagccttgcttgcttttgccttttcttataacttgggtttataggttccctaatggttttgtgatccatttaattttaactgagccaagactgacttctttgtaattaagaagtgaatgactgggtgactcttgttagggaatagatgtgtggagagctccatgaattactctaaaccaacaatcacagctggtgaaagttatttaaaaaattttttaagattttatttttattgtacacatttaaggtatacaacatgatgttttgatatacatatacatagttaattactatagtcaagccaattaacatattcatcatcccacatagttttcttgttttgggaagaccacataaaatctactctcttaccgaatttccagtagacaatactaataatcaagtaacccagtgacttctgctctgcaatagcagtgtgaggagctctgtggagatactctttaaccaaacaaccatctgggaattgttctacatgcatacatttatttttaaaactctactaaaccttgaaagaacacagagtgcccgtgccatttgagccataacccactatgtactttctacctcccagctcagcatgagggaagctgcacttggggcatgtatagccaagaacagggaaaatcccttttctcccacctccctgtcaaagattatgatgtctctctaagaagaaaaggctgcaggcatcacctaacctccctcccaggtgatgttgtagaggttgtattgcaggtgtgtgtgaccaagaggtatgaggctccattcttccacccaacaccacttgtattgtagagggtgtaccccaggcattggaggtaaagaatattgtgaccccataccccctggcacagctaattagtagggtagagttttcaagttagggaatgcatgccaacaacatcagaggctactgcttatgcccagaaccatgttggtaaaacaaggctgccaccctgagagaagtgggccactatttccaaaaaaagctccatagaaaaagctcactgattttccaatggtgaaacctaagctataagaacagagggctccaaagtcctcccaaagaaactgactattatcttggaacagagtgtgaggaatgtctagactaatagtgttcttgaaaacaatgggaattttagtggtaaaccatgaagaggaggttggcagctccatggcagaaaatctaatgattaaggaaactgaacataccacctgataaagtagcatttgagaatttccagaaatatattgagggtaaattgtcatgaaaaagggagttacccatgacacattttaatgctaccaattttgtcataataacatgtcaacgtaattagaacatatggtattaatgaaggaagtacacacacatatcagtggaaaaaaaagaaacttggtgccttcgaaaatctagcagacaataaaggcagaatcctgcattatccaagaaatgttagataagtcagtaaatgatattaagacagattaccagcaattcaggggaaatactggatttgtatcttacacgttatctcaaagtatgtttcagatggtcaagaatttaaatataaagattgaactataaaagtattcaaagaacacgagtggagttttgtaaaatgttgatatgggaatgactttctggagcaaattggtattgttaaccatatgcaaataaaaaaattttgttgggaaaaatctaacatattgtaatataagcaattagaaattcaaaaatatgagtacattcgtggtgggaataaatataatctatattacattgaaagaacgtttataacataaaagaaaacagatgatccaatagaaaaatgagcatgaaccacatatatatgatttatgggaaaagtaatgtaagtagataacagatgtatgaaaataaatacaacttcaaccaaaattaaataaatgttatttaaaacaaacacacaagttatttttttgttcctatgggatggtctttttactactgattttgggcaaatttcatttgccagtagtctgcgtctcagttattgtgaaatgaataccttgatcgcttaagacctttcttactatgagaaagacttcagggatctaagctaaggtctctgccaggggaagcgtgaatttgcaatagaggagcagaaaatgtgtgcagtggaatcactgtaagtgaggatgccaaggtgatgcagaagaggttgatgctggcagacttgacattttgtggcatgtcactttattttttatttttatttttactttttttgagacaaggtctcactctgttgctcaggctggagtgcagtggcgcgatctcagctcactgcaacctccacctcccgggttcaagcaattctcctgtctcagcatcccaagtagcttggactacaggcgcatgccaccatgtccggctaatttttgtatttttagtagagatggggtttcgccatattggttaggctggtctcaaactcctgacctcaggtgatccacctgccttggtcccccaaagtgctgggattacaggcatgagccactgcgcctggccagtatgtcactttataatcacgttcctttcatcttcatggtgtccccaaatctatgtttttctttgattgcacaccttgtctcagtcatcccattactctgattcctgctattactttgctttctgtcttggcaaaacgagttcatcacaagtctttcctgaaaggctaccaaatcttccttccttggtcaacatcctagcaaagagaaatgacatatgaagacaggtagttcccagccccaagtctgctcctgacttctagagtaagcttgatggctcccctggactccagttttcccatcttcatgatgagggtgtttatcgagattatttcaaagaggacttccaacttcaaattcaacagaaggttgtggctcagggatctattataagccaagaagcacatgatgcttgtgcgtgatccttgtgattctggactccaggagacacacacatggctggctagaaccgagtctctccatcccagcatgtaccggacaaggagatcctaagaagactgtcccaaaattgtcatcagtgattctctctactcaacccctgtggagcacacagagcctgcaaatatgatagcagagtttttagtctcagcaaaaactcctctgctagcgaaactgtttctaggaggagcatggttgcaggaggctgtccctgaataaccatgtgttttctgtctgcaatgcaaattccaagtagtgaattaccatactagcacctctgggtaacttcagtatcatcatgcagccccaaacttctcatctttcccatcatttttgatctcgcctcaccattacactcagagatactacaaggcagtaggtagtttagagaatccagccaaaaagccctagagagtctactgtctccaatctccactttgcttatacagttgggtaaaatgtaggccacaagctggggctagaacacagagtggaggagagcagggaacagtagctgctctggtgctcacaatgagatgagaacagtcgtgtggacaacttcatgtcttggtttctaagcatacgagcaccattcccagaagttgcaaagtccacatgcctacttccctgccttcttggaagcctccacatgtgcactggttcatacagtcagaggaacacactctgtgatggactgaggactgggatagagaaagaagcagatatggagatggcaggaagtgtttactctggtagcagtggcatcagtggctgggtatctacttccaggaagacaagtggaagaggtgtccaatttggcaatgttggtgggcagatgtggtgtcaccatgcctggaggcagcagtggtgtgctctgttgtgattggagagaaaaaggctgtgggactggtattgttgaggtatgtgtgcccataaaatcactaagcactaggctgggaggacaaagtattatctagtgtggagaagctgaggatgcagcctgcgattaaaatatggatagaaaaacaggtcaggccaattaaaggtgatcttgtgaaataaattattgctggcggagaaactcataaaggggtatctcgctgtctagctcaataagagaaaacacattttagggatgttttcaaggtgattgtagagtgtagacttctacttccagaggtggcaacatttttgctgtttctgttgcacctgctaatgtaaggagtgcctggagtttgatggggagtttggaaccctgtgaaaatccagtgtaagagagatttgtatgcttttgactgctcacaatgtggcagtcctttgttacattgtggcacctccctattcacaccatatttgagacttggtgagtgacagaattggcctcttgttgcaggaatgaaacaaaccagagagtcacttttctttacccattagacctagggctgtgctgataatatactcagcaaatgatgcttctacctggagcattgagaactaaaagactaaaagcagcaacgataaaggggcattctttcttagcacaaggtagttttgttgttcacagtgacacctgatttcagggtcatgggtgacagtgatgagtgtccaggattgcagcagtaggacccatgtcacacaattgttgaggggtggttctggctgtgatcatgctgcctggatactcttacttcttacattgcctctgagtctgaatcttccgtcttctcaaaattctgtaagccgcatttacagattgggttatccagaaagcaagagctgagacacagctaagagggcaagttgccttgtggggtcacacctgttacagtaaaggaaaggaagaaggactggcagaggatgccattgccaacctgacctgacaacatctctggcaacccatcagggagctctggagcaagaattttccattagaggagtccaacattgagcagaaaaggtagacccttataccacagccttattcttcctttagctggggcccctggttctacgtgatctgagctcaaacactgagggttactttctgttctaaattggatggaaggctgtgtgattaagggacatactaagaagtgataaacagtgggttcctgtttttacctcctagtgctggcacctgcttaccctgagaaggttggctcatatgactggatgaaagagagtctctctgtcccagttccagacagggcataagaagtggcttgagttttccttaaggagtccagtagctgctctattattactcctcaaggatgattatggaacctcagggattagcacgggctcttgggctcagaaggaaatcagggtcctggtggatgttgcattgttggatctaggtggtgggagcaagaggagtaggatagagaatatgtgtctcctcctataactgaaaacttcacatttgctgtactcatgaagccactgtgagtggtttgaatggtgttttaggtaatctaaatgtgcaaggcagaccccaaatccagtcattttcccccttcttctaacttcctacccacatattcagatgtgccctcagaaacctctaggtagtttggaggctctgttagaggggctcagaaacctccacatgctcaggccttcacttttccagatggtgctactgagattagtgagaacaagggatttgttgatgtccgttaggagtaggacttaggtctggaagatggcacagtactgtcagttcctgaattccagaaaggaatcagagaacaaatggtgcctagaaggaggatgaagctggataagcgaatgtgggtaaacagactctcttctctacccagttacacagtcttctaggtgggcaggaccacgtcttgataggcctaaaaccaaaggacacgtgttccaaaattttctctctccaaaatagaccctgatcatgctgtgaattcttttttcctttcaattaataatttcctttgaaattcaaattaattggaaataatgacaagctccaaatatcaggagacatcttcagacatcagttggaatcatagaaattacatttgaaacaattggatcaagtcagctcttttcatacaatggtacaatgaacccatgtctgggaatcagggagccagttgtattctgggcttgacttactgagtgaaattaggaaaggcattcctttcttcaggggtccgtgcaatcaagataaagcaaagagggaaaatacatctctctacagtgattttatttcttccttatgcccttcaagaattgttttgttaatcaagtgtcaatatctctagggaggccatgcaggggcagcaaagtgaaacatgttggggcctcatacctctctttgaagtcctgggtctccaagcccttgtctggttccagcactccttggacaaggctgtcttccctagtaacagcacctctcattgcttgggaagttgggagaactggtaccccatacgtgcctttgaaacttgatttgtgtctggaggacacatccaatgcatggatcacattcagaattattgcagagggaagcaatgaaatggcagcaagaaaattaacatcttttcaactcgcccaagacatgactcacagtttcttttttctgagttgatctccatcaagtgcattaataatttttctccaagttctttcagtgagcagtttctaggggatctttggcatagttgaagacaatagaaggcagaagaggaggaatgagtaacttccacaatctcctcctcaagtggtataaaattactctatcattaagaaattcctaagcaaacttcaccctcaacataacttgaaaacaaagaatgccaaaaatacaaaatacctgtcagtgaaaagggaacaaacaacaaatcccagtgctggggactcacacttacctgccctttccagccccactataaagcttaaagctttgcaaaattgaccaaaacacacacacacacacacacacacacaccccactgctgaggaaggagtgacatcaccaagatggtgaaatagaaggtcacccagtcgtgtcccaccacaaccataagaattctacaccattcacaggttaaagtctctctgagggagcctctggatccagggagaaatttgtgaaatgccagtggagctcaagcccttagaggattattttgagagtgcagacagacacccaggtggctgatctgctgaacctgctgctcgcgagttcaatcctggaagtggcccagtcctcccagggtttggctactgtaccatgttgactttagcctgcaaccaaaaccatctgccaaggggtccagaaggaattacacacacttggcagaaaggctgctctgcacactgacattgtctggatagtgaacctgaaagttgccctgtggctttgtccagcccccatcaactaaagtcccagcttagagctgcttacacaactcacagggagacccatacatatctcacaggccagcagtctgagcctcccggataggcatgccatcctttgtcccacagcaggtctagatgggatctgctctaagctccagcccatcttgccatagttggggaactatcctgtcagtgctgagatctgctggaagacatgtactggcctggacccaaaagattggctcttcagcttccatcccacagcagatcctgaggggattccagttgcagcttttgtccttcctgctgaaattggaaaactctcttgtctgtgcaggaacttgctgggagacgtgcttacctgtaaaccaatgagaccaggttttcagcctctgccccacagcatattgtgagggggcccagtctcagctccccttctgactgcaattgaggaactaccacatgtgctaaaatcttctgaaagatgtgtgcctatctgagccaatgagatggacactccattctctcccccacagcagatcatgagagggcccagtttcagttccagccaaccctgctgcaattggggaactatgccacttgttcagagtcctccctgaaaatgtgcttctgcctgagccaacatgacaggcatgccagtctctgtcccatgaatggacttcttgccacagtagatcccaagtgagcccagtctcaactctagccactctcactgcagttgggaacccatctgcctatgtagagacctgcaaaaaatttcatccatctgagacatagcaacatttttggactatgatttctcaccagcattcccacatgtccccagtaccctccttgggtcttctgcatgtccatttaaactagaaatctgcgttaacttcagagccttgcaagacttacagcaagcctgggctcagagtgtcctctagtgttgagacaattgcaatggtctcagatacaggaaactcattaagcggtctgtttggaatctctggaaggccctctgaataagaataagagcaaacaaagccagactgtgaagattaaaatgaatatctaatctttaaatgtgtagacattgttgcacatccacaagcatcaagagcgttcagagaaatataacctgaccgaatatgacaaaataagatgccaaagactgacccttaagtgatggagatgtgtgatttctcaaacgaagaattcaaaatagctgttttaaggaagctccacaaatttcaaaaaaaacccctacagagtatctgatatactttggctgtgtccccactgaaatctcatcttgaatggttgttcccataatccccatgtgtagtggaagtgatccaccgggaggtaattgaatcatggggacagttacctccatgctgttctcatgatagtgagtgagttctcatgagatctgattgttttataaggggctttccctgcttttgctcagcacttctccttcctgccatcatgtgaattaggacatgtttgcttccccttccaccatgattgtaagtttcctgaggcctccccagccatgtggaactgtgagtcatttaaatctctttcctttataagttacccagtctcaggcagtctcttatagcagcatgagaatggcctaatacagtacattgttaccaagtagtcagatgctgctgtaaagataccccaaaatatggaagtgactttggaatggggtaacaggcagagattggaacagtttggagggctcagaagaagacaggaagatgtgggaaagtttggaacttcctagagacttgttgaatggctttgaccaaaatgctgacagtgatatggacaatgaagtccaggctgaggtggtctcagatggagatgaagaacttgttggaaactggaagaaaggtgactcttgctatgttttagcaaagagactgttgacattttgcccctgacctagagatctgtgtgaactttgaacttgagagggatgatttagggtatctggcagaagaaatttctaaccacaaagctttcaagatgtgacttggtgttgttaaaagcattcagttttatgtattaacaaagatatggcttggaattggaacttatatttaaaagggaagcagagaataaaagttcagaaaattttcaccctgacgatgtgctaggaaagaaaaacccatttttggtggagaaattgaagctactgcagaaatttgtgtaagtaatgagaagccaaatgttaattgcccagacactggggaaaatgtctccagggcgtgtcagaggatttcacagcagcccctcccatcacaggcctggaagcctaggaggaaaaagtggttttataggctgggtccagggcttgcttctttgtgcagtcttgggacttggtgccctgcatcctggccatggctaaaaggggccaagatacagctcaggccatggcttcagagggtgcaagctccaagcctggggagcttccttgtggtgttgagcctgtgggtgcacagaactcaagaattgagatttgggaacctttgcctagatttcagaggatgtatggaaatgtctggatgtccaggcagaagtttgcttcaggagcagggccatcatggagaacctctgctagggcagtgtggaagggaaatatgagatcagagtccccacacagagtccccactgggtcactgcctaatggagctgtgagaagagggccaccatcctgcagaccccagaatggtagatccactgacagcttgcaatgtgcaccttgagaagccacagacaatgccagcccatgaaagaagcctggaggggggctgtaccctgcaaagccacagggacagagctgcccaaggctgtggagctcaccttttgcatcagcgtgacctggatgtgagacatggagtcaaaagagattattttggaatttgaagatttaattactgcctcattggatcttggacttgcatggagcctgtagcccctttgttttggccaactcatcccatttccaatgggtgtatttacccaatacctgtacccccattgtatctaggaagtaactaagttgcttttgattttacaggctgataggtggaagggacttaatttgtctcagatgaaacttcggacttggacttttgggttaatgctagaataaatcaagatgttgggggactactggaatggcataattgtgttttgaaatgtgaggacatgagatttgggaggggccggggcagaatgctatggtttggctgtgtccccacccaaatctcatcttgaattgtagttcccataatctccatgtgtcaagggagggacccagtgggaggtaattggatcatgggggtggttacttccaggctggtctcatgatagtgagtgagttctcatgagatctgatggtttcataagggacttttcccccttttgtttggcacttctccttcctgccaacagaagtgccatcctttttttggcacttccccttcccatggaaggggaagaacgtgtttacttccccttccacaatgattgtaagtttcctgaggcctccccagtcatgcaaaatggtgagtcaattaaatcgctttctttataaattccccagtcattggcagtcctttatagcagtgtgagaacagactaatacagaatcaattcagaaacgtatgagaaaatgttaacagagagattgaatataatttttgaagatcaaacagaatattagacctgaaaaatgcaatgaataaaatgaaaaagatacaattaagaatgtcaaaggcagaattgatcaaataaaacaaataagaaagaaaggaagaaaaaaggcaaacaacaataacaacaataaaaatgcagcttctttttcttttttccttggaaggggtttatgacacactcttccagtggctacctagtggcctggcttctaactaacttgcattggggagttaaagaagcagacaagtgttaacctgagaagtagatagccacttttcaagctttcttctccagctcactgcagtgataattaagtctattaattccacctggaaggaatttgttcacacatttcacacatcaagtgccccaacttttacaatttccacctgagggaactaatcctcctagttctgggagtagaggagactggaatgcatgtctcttccaaccacagttaaaaaaagtgacagttttatatgggcatgtgagcacatctggggttacatcgcccaggaagagtaaggagaagaggtatagaaaaaccctgtcccatttttccccagaaagtgtttatgccatgtatcagttgccccaagtcagacagctacctcctgaaggactccttaaacttcttagctctgtgaacagggggacaagcatattctagtctttctagatcatggaacaaaaaagttggttttaaatgggagtgcaacaaattccaggggctactcccccttgaagaagtacagaaaaggagcaagaatgtgcagctcttattttctctccagaaagggcttacagcacactcttcctgtggctaagtgatggcctagctattaatgaacttgcatttgggagttaatggggtaaacaaacaagagccctctgacagccagagcaagggtttggcacttcttgagacttccatccagcttgcccaatgataaatctaggcttactcattcttcctggaaggagtttggctatggaccaagtactgcaagttttatagctctcaccaaatggactatctctttaacaacttagctgtgagagtcaatggggctttgtattcctgagctgccctaaactacagaaaacaaagaagtggttttacaacaatttcgttccagaagctatctgtctatagcagagggtgttatgatcagagggtgcagcatcagtgtgagcacagcatttcccacgatcagagggtgcagcctgaacaggagcacagcatttgccacagattatctccctggcttactgcaaagagttttggaccataatgcccatgctcagcttcagcgaagatagatgaaactggaacacacattcatcatcccaatcctttcagttacatttagagagtcaggcttctaccttagcagtctctgggtacagataggaggaggcacatcctaagctctatggagacatcaaaaacagagccagcagtctgaaaaaacacaaatatttgagaagcatcttaaaatctctgaccaggtggattggtggaatttttttttcctacaaaatcacagtttgacaggactggaagttgtagttgtcttatctaatatgcagaaatcaacacaaagagtcaagaaagacaaagaaacatgggaatatataagaacaaaacaaaacaaataaataaaccaaacaaaatcaggaagccagcccaaatgaaatggggatatgttatttacccaaaagagaattaaaaataatgattataaagatgctcagcgaggtcagaaggggaatgcaagaagaaactcagaatttcaacaaagagatagtataaaaaagtagcaaacagaaatcatggatctgaagaatactataactgaactgaaatattcaatagagaggttcaatagcagactaaatcaaggagaaagaaaaactggtgaattagaatacaggccactggaaatcatccaatctaaggagaaaaaaaaacaaaaaacaagaaaacaaaagcaagagtgaaaaagggtgaaggtagcctaagtgacttccaggacactaccaagagggaaaagcctatgcattattggcatgtcagaagtagaggaaggagaaaagggaacagaaaacatatctgaagaaatgatggcaaaacttcataagccaaaggaaaaaaaaaatcctgatcctagtagtaagcctaaatgacaccaactaagatgaatccaaggagactcaaaccaggaagcattataatcatattgttaaaagtttaagatagaaatggaacgtttaaagcagcaaaagagatacaaatcatcatgtataagggaaccctcatagactaacagcagatttctcagcagaaaacttgcaggccaaaaagaagtagaataacttattcaaggtcctgaaagacaaaattgtcaaccaagaatacagtacccagaagacctgtcttacaaaacatgctgaagagagttttcaagctgaacaaaaaggatgctgataagattcatgaaataaaatgaaaatataaaactcattggtaaaagtaagcacactgtcaaattgtaaacactttaatactgtaatggtggtgggcaaatcatttatacctccagtacaaagattaaaaagaaaatatattaaaaacaaatagaggtactataatttgttgagggatacaaaattataaaaagatatatattgtgacttcaaaaatataaacatgggaagagagggagcaaaaactagaggttgtatgtgttatcaaaataaagttgttatcaatttaaaataggctgtaataagtatgtcttatgcaaacatcagggcaaccccaagccacaccttataatagctgtaaaataaataaaaaagaaaagatccaaagaataccactagagaaagtcatcaaaccacaaaggaagaaaacaaaagaggaagaaaggaacgaaggatctacaattgaaccagaagacaattaacaaaacggcaatagtaaccctttacctatcaataattactttaagtgtaaatgaataaaattatccaattaaaagtcatagagtgtatgaatagatgaaacaaagactcaattcgatgctgcctacaaaagacttattttaccttaaggaagacttatagactgaaggtaacatctttttattataaaaacttgcaagaaatgaggtatagaagaaatgttcctcaatgcaataaaggccatacatgacaagccagaactaaaatcaagatggtgaaaggcttttccactaagatcaggaacaagacaagaatgcactctcccaccacttgtcaacatagtattggaagtcctagtcagagaaattagggaccagaaaaaataaaaggcatccaaataggaaaggatgaagtgaaatagtctctgtttgctgatgtcattatcttatatataaaaaatccaaaaatactacaaaaatcagttggaactgataaataaatccagtaatgttgcaggatacaaaatcaacttgcaaaattcagtagtgtgtctaaacacagttcaatgtttaaaactgtctgaaaaagaaatttaaaaaacaatcccatttataatagcataaatacttaggagcaaatttaacaaaaaataaaatatctgtatattgaaaactagaaaacattgattaaaaaaactgaagatgacacaagtatatggaaacatataccatattcattaatcaaaataattaatagtgttaaattgttcatacttaaagtgatctacagattcactgctatccctatcaaaattcatgtcattctttaccaaaatagaaaatacgatcttaaagtgtgaatggaactaaaggagccccccaataaccaaaagaatcctgaacaagaagaacaaagcaggaggcatcacactgccagatttcaaaatatattgcacagctatagtaatcaaaacatcatagtattggcattaaaaacagacattttggctaatgaaatagcatgaggaataaccccacatatctacagtaaattgatttctgacaaaggtaccaataagacacaatgaagaaatgggagtctcttcaataagtggtgttgggaaaatgcaatatctacatacagaagagtgaaaatggactcttatctcaccccttacacaagcatcaattttaaatgtattacaaacctaaatgtaagacctgaaactataaaactatgagaagggacaaatactgcaaaagaaaaactccatgacattgatctgaatggagatgtattgaatatgatgccaaaaacacagacaatgaagacaaagatacacaaagggtttgtttttagagaaaagctctcactctgtcactccattgcctatgctggagtgaagtggcatgctcacagctcactgcagtcttgacccctgggcctgagggattctcctgcctcagcctccctagtagctgggataatgtctagctaagtaaaaaaaaaaaaaatttagtagacagagggtcttgatatgttgcccaggctgctctctaactgtgagaccccatcccccaacctggccaatgaccactgccttggcctaccaaagggctgaaattacaggtatgagctactgctctaagtcaagacttaactttttgatgggctggtggattcagtttgctagtaattatattgaggatttttgggtatatgttcatcaggaatactggctggaagttttctttttctacatgtctctgccagattttgggatcagaatgatgctggcttcatagaaagagttagggaagagttgtcctagatttttttggaatagtttcactaggattggtaggacctcttctttgtatttttgttagaatttggctgtgaatccacctggtctagggctttcattggtaggtagggttttttaaaaaattactgattcaatttcagaactagtctttggtctatttaagttttcactttcttccttattcaatcttgggaggtcatttgtttccagaaatgtatccattttctctagattctctaatttatttgcatatgtttataaccgtctttgaggatattttctattctcgtgggatcagttttaatatcatctttgttatttctgattgtgtttatttggatattctctttttgtctttgtaatctagctaatggtctatcaatctagtttattctttcaaagaaccaacttttggtttcgttggcttttgtatgactttttacatcctaattttattcagatctacttattttagttatttcttttcttctactagctttgggtttggtttgctcttgttttccaagtttctctcagtgtgatgttatattgttaatttgagatctttctatccttttggtttaggtcttcagtgctataaactttcctcttaacactgctttagctgcatcccaaattattttaataatgttgtttttgtctattttcatcaatttcaaagaatttttaaatttctcacttaatgttgggaaaatggaatatctacatagagaagagtgaaaacagactcttatctcaccccttatacaagcatcaattttaaatgtattacaaacctaaatgtaagacctgaaactataaaactatagctttcttcattcaggagcaagttgtttaatttctgtgtaattattgacatcttgactgtgtaaagtcttactatttaggatcatcatacatgtttattcaagcatttttaatgtacctctgaaaacagaacattggccagtagacctcatgtttttctggatatgatggcaaaggccagaaagctaaggtgtgggctccagtgctgcctattgctccagaagtgccacctgtcttgacccaggagactccagagagactattgtttgtccaacccagtcccatcaggacatctgttcactcatctcccattacagctgcctctactgccagtgtcctaaggatgaggaccaccattgggaccaagaagctgctggctttcatattgtcagtaaggtgcttgacaaagagctgagaccaaatctgtctttatgcagtcccagcttggcctggctccaggggtgggtctggtatttacaaggaacaagacatagccttagctctatcaggaaatatccacccctttatggagggccctggaatctttacccaaaaattattcactgggataagcgacagacattacattacatcacatcaccactgattctcccaagagcttttctactttcttgcagagaagaagtgctggctcacttctcaggcaacattgcaatcaaattcttaatattttcaaacactctgagacccaagaatagaagagagttacccaaggtcattcagctactcactgggaaatccagtcttgattataaagccagggtgtttccctattatgtcctcatcctacaaaccccacccagatctaccctatcattttactcctcccagtatcacactgggcttttctttccttcttctctggtcttgagaaaaactttgtaaggaagtttgttttaaaagcttaatggctaatcattgtgaaactctaagcacaagagaaagaaaaaatgtactaatgagattcaaaatatttgggaaggcaagagaaagtatcagtaaacttcaagatatgtcttttgaaatgatcccatctgtagaacaaaggaaaaaggaagaaaaaagaacatgcctgagaatactgtgggacatcatcaagcttacctacataggcataatggaagtcccagaacaagaaaaacacaaaggggaagaaaaaatatttgaagtaataatggcaatagtcacattcttgatgatatatgtgactctatatttccgtgaatctcaaagaactccaagcagtataaacttaaagaaacctacatttatgcatattatatccaattgttgaagctcaaagacaaagggagaagccataaagcagcaagagagaagtaactcactacatacaatagattcttaagatattagcttcagatttcttgccagaaaccatgtttgtcagaaggcaatgagaaaacattttcaaagtgctgaaaaaaaaacctatcagccaagaattctgtatgtagcataattatccttcaaaaatgaaggagaaatgaagacattcctagtataaaaaagtgagagtttgtagttaggagacttactctataagaaatgctaaagggagttcttcaggctgaaatgaaaagaaactagacactattcaaagtcatacaaagaaagaaagaacactggtaaaagtaactacataggtaaatatagaagccaacattatgaattacttgtaacttcccacttttctataagatttaaaggcaaatgcatgagaatattattataaagctcattaatgggtacatgatgtgacaataaaaacatatagaaggttatactaatgtgtgagtgagcatgaatcccactgccactgctcaatgaagtgctttggccagtaccacacattggaatattatggccagaggactgagaacacctcagcaatccagagcagcaggtttctaactttgaggggcccaagaataaagctaggggcctgttaccacccccactccagagttagagcatgcagtccaggggtcctgaactgagccttgggccttaaaatcatgccagaaatgaacccagttgactgaactcaacttatagcaaaatcaaccacccaagggcatcaaagaagataaaagcaaacaaaacaaaaaacaactcatccaaaggacagcaacttcaaatgttgaaggaacattgcctgcaaagatgagaaagaaccaacgcaagaactctggcaactcaaaaggtggcagtgtgtttttacctccaaatgaccatattagttttccagaaatggttcttaaccaggcttaaatggctgaaatggcagaaatagaattcagaatatggataggaatgaagatgattgagattcaggagaaagtaaaaacccattccatgaaatcttaggaatacaataaaatgataccaggaataaagatatagtggccatttcaagaaagaacaaaactgatctgatagaactgaaaatctgacttcaaggttttcagaatacaattgcaagtagaatcaaccaagatgaggaaagaatctcagagcttaagacctcaaagctattttggttcttcaaaataactcagtcagacaaaaataaaatgaaaacgattatgaagaatgaggaaaacctccaagaaatatgggaatatgtaaagagaccaaatctgtgactcactggtgttcccgaaaggagggagagaaagtgaggaacttggaaaacatatttgagaatattacccacgaaaatttgcccaacctcactagagaggccaagattcaaattcaggacatgtagagaacccctgcaaaatatcatactagatgaccaatcccaagatgcataatcatcagattctccaagatcaaaataaaaaaaaaatgttaagggcagctagaaagaagaggcaggtcacctacaaagggaagcccatcaggctaatgacaaacctgtcagcagaaactatacaagccaggagaaattgggggcctatattcagcatttttaaagaaaagaaattccaaccgagaatttaatatccagccaaactaagcttcataagtcaaggagaaatacaatctttttcaaggaaggaaatgcaaagagaattcattaccaccagacctgccttacaaaaggccctaaagggagtgataaatatggaaagaaaagaccattaccagccactaaaaaacacacttaagtacataaaccattgacactataaagcaaccacacaaccaaattttgtattaaccaggtaacaatacaatgacaggatcaaaaccacacctatctatattaaccttgaatgtaaaaaggctaaatgtcccaattaaaaggcacagagtggtaagttggatagagaaccaagacacaactgtatgctgtcttcaagagtccatctcacatgcaatgacacctataggctcaaagtaaagggatgcagaaaaatctaccaaacagacacaacacagaaaaagccaggtgttcctattctaatttcaggcaaaacagactttaaaccaatagagattaaaaacacacacacacacacaaagaagggcattagagaatggtgaaaggcttagttcagcatgaagacctagctctgctaaatatatatgcatctagcacaggagcacccagattcctaagtcaagctcctaaagacctatgaagaaacttagataaccacacaataatagtgggagactttaacaccccactgacagaattagacagatctttgaggcagaaaataacaaagatatttgggacctgaactcaacactgaaccaaatggacctaacagatatctacaggactccccacccaaaaccaacataatactcactcttctcatttgcacttgccacatactctaaaattgacctcacaatttgacataaaacaatcctcagcaaattcaaaaacaccacattcataccaaccacactcttggaccacagcacaataaaaatagaaatcaatgcaaagaaaattgctcaaagccatgcaattacatggaaattaaacaaccagcttcttaatgatgtctcagtaaataatgaaattaaggcagacatcaagaaattcttcaaaactagtgaaaaaaaaatacagcataccagaatctgtgggacatagccaaagcagtgttaagggaaaagtttataacactaaatgcccacattaaaaagttagaaagatctcaaattaacaacttaagattacaactagaggaactagagaaaccagagtaaaccaacaccaaatctagcagaagacaagaagtaacaaaagtaagagctgaactgaaggaaattgagacacaaaaaaacacgcaaaattcaatgaatccagaagctgtttccttaaaagaataaagaagattgatatattattagctagggggataaagaaaaaaagagagaagatccaagtaaacacaaccagaaatcacaaaggggatgttatcactaaccccacagaaatacaaacaactctcggagactacttggaacactctgcagacaaattagaaaacctaaagcaaatggataatattctagaattgtacaaccttaagattcaatcagaaagaaattgaatcccaaaagcaatggcaacaaaagccaaaattgacaaatgggatctaattaaactaaagagctgctgcaccgcaagagaaactaccaacagagtgaacagagtgaacaggcaacctacggaatgggagaaaatttttgcaatttactcatctgacaaagggctaatatccagaatctacaaagaactcaaacaaatttacaagaaaaaaacaaacaaccccatcaaaaagtgggcaaaggatatgaacagacatttctaaaaagaagacatttatgcagccaatagacacatgaaaaaatgctgatcatcactggccatcagagaaatgcaaatcaaaacctcaatgagataccatctcacactggttagaatggtgatcattaaaaagtcaggaaacaacaggtactggagatgatgtggagaaacaggaacacttctacactgttggtgggactgtaaactagttcaaccattgtggaagacagtgtggggattcctcaaggatctagaactagaaatactatttgacccagccatcccattactgggtatatacccaaaggattataaatcatgcggctataaagacacatggacacgtatgtttattgcagcactattcacaatagcaaagacttggaaccaacccaaaattccatcaatgatagactggattaagaaaatgtggcccatatacatcatggaatactatgcagccataaaaaaggatgagttcgtgtcctttgtagggacatggatgaagctggaaaccataattctcagcaaactatcacaaggacaaaaaaccaaacaccgcatattctcactcataggtgggaattgaacaatgagaacacttggacacaggaaggggaacatcacacaccagggcctgtcatggggagcggggagggatagcattaggagatatacctaatgtaaatgacgagttaatgggtgcagcacaccagcatggcacatgtatacatatgtaacaaacctgcatgttgtgtacatgtaccctagaacttaaagtataataaaaatgtatacataaaaaaattaaaaggctattaacttcaaaaaaaaaaaaagcctaccaacaagaaaaagctcaggaccaaacaattcacagtcaaatttataacatgtataaagaaaagctcatattgctcctactgaaactattccaaaaaactggagaggagggactcctccccaactcattctattaggcatcatcctgataccaaaacctggcagagacacaacaacaaaaaaaacttcaggccattgtccttggcaaacactgatgcaaaactccttaaaaaattactagcaaatcaaatccaacaacacatcaagaagtgaatccaccatgatcaagtaggctttaactttgggatgcaaggttggttcaacacttgtgaattaataattgtgattcactacatacacagaactaaaaacaaaaatgtgattatcacaacagatgcagaaaaaggttttgataatgttcagtgttccttcatgttaaaaaccctccacaaactaggcattgaaggaacatacttgaaagtaatgagtcatttctgaaaatcctacagccaggataatagtaaatgggcaaaagctggaagcatttcccttgaataacagaacaagacaaggattccctctctcacctctcctattcaacatagcactggaagtcctagctagaggaatcaggaaagagaaagaaataagaagtttccaaataggaagagaggaagttaaactatccctgtttgcaggcaatatgattctatacctagaaaaccccatagtttctgtctaaaagcttcttgatctgataaaccacttcagaaaagtttcaggatacaaaattaatgcacaaaagtcagcagcattcctatataccaacaaatctaagctgagataaatcagaaatgcaatctcattaacaatagccaaataagaaaaaaattcctaggaatatagttaacccaggaagtgaaacatctttacaacaagaattacaaaccactactcaaagaaataagagatgacacaaataaatggaaaaacattcctatgctcatggttaggaagaatcaatattgttaaaatggccatactacccaaaacaatttacagattcaattctattcctatgaaactaccaatgacattcttcacaaaagtagaaaaaactattttaaaatttatatggaaccaaaaaagagcctgaatagctgagtcaatcctaagcaaaaagaacaaagcgggaggtgacacattgcttgactgcaaactatacttcaaggctgcagtaaccaaaactgcatggtactggtacaaaaacagatacctagaacaatggaacattacagagcccagaaataattaatgctgcaaacctacaactatctaatcttcaacaaaatcaacaaaaaaagaaacaatgggggaagggacttcctattaaataaatgattctggaataactggctagccatatgcagaagactgaaattgtaccccttccttaaaccatatacaaaaatctactcaagatgtattaaagacttaaatgtaaaacataaaactataaaaccctgcaaggtaacctaggaaatatgattctggacgtagaacttggtaaatatttcatgatgaagatgccaaaagcaatagcaacaaaaacaaaacttgacaaataggacctagttaaactaaaaagcttccgcacagcaaaagaaactatcagcacagtaaaccaacaacctacagaatagaagaaaatatttgtgagctatgtgtccaacaaaggtctaatatccagaatctataaggaacttaaaccagttaacaagcaaaaaacagacaaccccattagaaagtgggcaaaggacatgaacagaaacttctcaaaagaaaacatacatgttgccaacaaacaaatgaaaaaatgctcaacatcacagatcattagagaaatgaaaatccaaacagtaattgagatagcatctcacaccagtcgttataacataacatatgctgtcaaggttgtagagaaaagggaacatttatacactgctggtaggaatgtaaattagttcagccagcatggaaagcagtatggcaatttctcaaagaacttaaaacagaattaccattcaacccaagatattccattaatggttatatacccaaaggaatataaatcattctatcataaagacacatccatgtagtatgtgaatcacagaactattcacagtatcaaagacatagaatcaacctaattgctcatcaatgatagactggataaagaaaatgtggtatgtaaacaccatagaatactacgagtcataaaaaagaacaagatcatgtcctttgcagcaacatggatggagctggaggccattatcctaagcaaactttcacaagaacagaaaagaaaataccacattttctcacgtataaatgaaaactgaacattgagtacatatggacacaaagaagggaacaatggacactagggcctacttgagggtagagaatgggaggagcgtgaggatcaaaacacgaatcgagtactatgctgattacctggtgatgaaatacttctgcacacgaacccccccatgacatgaaatttacctatacaacaaacctgcacatgtacccctgaaactaaaataaaagttaaaaataaaaccccaaaattagacacacagtctgttcatgaggcttgatggaaacagcaggcaagtttatccactactggtgggattacaatatggtacaacccctatcaagggaaatatggcaatattatcaaaatttcaaatgcatttcacctttgtataagcaaatatacttctgggaatctggttcacaagaaagcaagctaagaaaggccacatgtggtatagtttgtaatggcaaaatattggaaacaacttgcgagggtagcaatgtgggtttattgaaagctaaggtagtctataaatgattcgctctgcagctttctctctctctctctctctccaagcaatcaaagaactagaacattactaataaccaacaacttaaatcaacccgtgtccttctcacccatccagaatgttttcttctctcgtttccagagttagccactatcttgtatgtcatttttatagttttttcattttttatgtatccctttttgagctttgcttcatatgtaaatatgcctaggcaatatatttcccagttctccttcatttgagttttatgacaagtgggtaattctaaatattgtcactgtggacttgtgttgtttattcaacattattttaattatggtcatattgtgcatggctgtaattcagttattttcataattgtataatacttccttgcattaatatgtcatgacatatttatgcattaatatgtcatgacatatttatccagtattttagtattggtaacatggactgtttccagtatgttattgttaaaaacagtacttttatgaacattattgtgcatgtttcttggtaaacatgtggaaatattttccttaattaaatctttaggagtgcaattgctgaattatagattgtgtacacattcaattttactagctgatgtcaaactgtttttaaatgtttcaccaatatagactctcattagtaatgcataaaagtttcttttctactacaaatcaataagaaaagataaacaacccattcaaatctaaaataaaagttgaaattaaataaataagtaaataaaaggtaagatacttgaattggcacttcacaaaagaggatagccaaatggataatagaaatattaaaaatgggccgggtgcagtggctcatgtctgtaatcctagcactttgggaggccaaggcaggtgcatcatctgaggtcagcggttcgagacaagcctgacca[133 bp omitted]gccattgaactccagcctgggtgacaagagcgaaattccatctcaaaaaaaaaaaaaaaaaaaaaaggagtattaaaaatgggtcagcttcaccagttattaggaaagtgtaaattcaaatcacaggaaatcccacaagatgtccacctgaatggctaatgaaaaggcaaatcatatgaggcattggtgagattatggagcaaatggaatgctcacacattgctgatagcagtgtgaattggtacaatgatgttggaaaattgattgcagtatttatgacagctggatgtatctatactctgtgatctgtactctgtgatccagcaattccattcctaaccatatatccaaaataaatgcatacctatgttctgcaagagatatgtacaagaatattcatagcaacactataatagctaaaacctagaaatatccaatgtatattgacagtagaatgaatatataacatttttggtatttttcatagaatactgtacagcagtgaaaatgatgaactacaggtgtagacttcaaaatggatgactctcaaaaatataatgttgagcaacataagcaggacatatgaacactataccttagatttcatttacatacaaattgaaaaagtatactaaactgaatatatatttcagaatacagacagaagtggcataactataaaggaaagcaagggctaattaccataaaatcttaggaagcagttatctctggggaggaaggagaatgaagcaactgaggagaggcatggagcatagatatagcaaatattctcctcctttacctggcagctcattttaatgctattctttaaagaatataggtattttctgtgagctttttatttgtttgtatggcttattgtacaatgagcttttgtgtaaggtagccaaaggcttccacagtctgacattcgtttatgtctccctcagtttcaggcttggtgggcatgtggtcagagtctaaatcgacaaggggtggggatttcaccagctgaattagtgtccaataattagtttgttaccttccctgccttaactccacctcaactcagtgactttcttaactcagattctgtccctgacaatacccaacttcaggatattcatttctattactcagaacttttggtaacaatgacagaatagtaagtcagactagctgaagcagagggctaatttattgcctcataacccaaccatgagaagggtgtgtgaagaactgctctcaaggtaaaggagggaaacctggctgtgtcatctgaatcttctctcaccatcacttctctccttgtctcagtgtattagagtcgtttttctcagacaattgatctccacccccagacttagataaccacttctggaattccctggttcatatatatcaccttttccagaagaaggaacccccgttttcccctttcattactcattcaaataaaatatgttaatagaccagaccaagtctcacacacaacacacacacacacactcacacacacacacacacacacacacccctacctgtggtcaggggtcaggctttcatgattagcagtccccattagactcacaagttgatggttcaaagagacaacaattcttcacaagaaacagggtgctgttcaaagaagtggggaggcatgctggacacacacactgtagatgtccaatgtatacatgatacatgttttctactactttctgattattttctccctaccactgtgatttcaagggcatcatccctcttcagacctagaattccaccttccaattactttcttgatgcatctgaaaggccgtctctgaaacagcaaagtgcaataattagtcattatgtattcaaggcaaatttgtcttacagagttttttgcaggaccagggaagaaggaaggaaatgcccagtttgatgctgggagtggtaaaatgataaagtagatctgggtggggtttgtagcaccagagcataatggagaaacaccttggttttgtaatcaagactggatctaccagtgacttgctgaataaccttcggtgattcctttctcttcttgggtctcactgtatttcaaaacatgaagaatttcattgtaatgttacctaataagtgagccagcacttctactctgtgagaaagtaggaaaactcttgggacaatcagagatgatgtgatgtaatgtccattagttcttcctgtgaataatcctgagggaaagcccccaggtccctcccagaatggggtggatatttcccaatacagctaaggaattatcccttgtaaataccacagacccgcccctggagccaggccaagctggactgcataaagattggtatggccttagctcttagccaaacaccttcctgacaccatgagggccagcagcttcttgatcgtggtggtgttcctcatcgctgggacgctggttctagaggcagctgtcacgggaggtgagtgaacaggtgacctgctgggctgggttggactaaggggagaccctctgggacaccctgggccaggacagggagcacttctgaagcagtaggcagcactggagcccagatttcagctttctgttctttgccatcatattcagaaaaaataggactttggctggtggactccacgtgctttccacctcagtgactgagatatcaggactgtttgtggaagtaatgttggtatgtggccttggcctcagatgtcaatacctgtgcagaatgtgcaataaaataatgaactccaggattttaaaccttgggtgtggacacagtcccccgtttctctgccccataaaagcactggagtaatcagtactctaaaaggaggttaagaaacaacaagccttcaggaatcatgttgtttgaggacccccattttataaggagggaaccaaaaatgtagaaatgagtgagcaattgccaaggtaattcccagagccaggatggggctcaagtctcctagtatgtggctcagggttctttcctactccaatgcacttcctaacaaatgacaatgtgtcctcttcactgctgggtgtcaccccagtctgaccactgctcctgagagacttggagtggaggaagggggaagaaacaaatactcaagggaactctggtccagtagaccaccccaaaaaaggaagagccttccaagagtgtagctcccagaggtgtaccttccctactcaggccatggtttgaggatgctgcagtaagcagtggatggacccagacccagaggaaagacatggcagctgaagcagaggcttactgggtataaatgtgggctcgtttcttcttttaacagttcctgttaaaggtcaagacactgtcaaaggccgtgttccattcaatggacaagatcccgttaaaggacaagtttcagttaaaggtcaagataaagtcaaagcgcaagagccagtcaaaggtccagtctccactaagcctggctcctgccccattatcttgatccggtgcgccatgttgaatccccctaaccgctgcttgaaagatactgactgcccaggaatcaagaagtgctgtgaaggctcttgcgggatggcctgtttcgttccccagtgaggtgagcactagctggagaacgaggagacccctgaagacacaaaagaaggctgagcggtggggaagcatcccaggttggtgggagggaggttgtgggaggtgacagaaagactgggagactgaggggtctgagaggctataaccagagtgcctagaaggatgatctgtcttcctcactgcctctgagtgctttgatgtgctgactctcacctctgatactcttctcttccacagagggagccggtccttgctgcacctgtgccgtccccagagctacaggccccatctggtcctaagtccctgctgcccttccccttcccacactgtccattcttcctcccattcaggatgcccacggctggagctgcctctctcatccactttccaataaagagttccttctgctccacttgtttctggttcctatgacttctgggctcctggatgctttggggaaatggatgtagaattgggacttcttctctccagtgaagaggggaaacggtcccatggtgaaagagagcagggcggggggaggaaacaggaggcacattgctagggcttcatattacaaatccaataatcagccccagtgctgccagctccttttcaccaggaaatggaaatatggaaatcttgcctttggccaaggaccaggaaaaacacaaaacacaaaaaataaataaacattacataaaccataagcaggtcttttttttccaatccaccatcagtcctgacctggctactgtcggccttaccagtgtgaccagccaacccttatggctgcaactacagctccccacttccttctcattaatgtttcccaggaatctatatcttttcaacaccacatagaaaggatgatgttacagatgctgcgaaactcctgctctttagaatttcactggtttatgcctgagattcctccatgaagtagcattcctttaggttaagcaatattctcttccagatttctgttttaagatgtgaatgaggaggcaagatacactaagtccttcatactatggtgtcagaggtttgggtgaatagcattctctggagacatacatgttgggggcagggcagacttgagtagtggagaaaggggcaggaatatgagcaacctcatggctctcctgttgacccactcgtcccactgcgattgcacaaggaaactctcagagaaggccacagcccccaggaggggagcagcctgggtgaaggggaataagcacaggcttgacagtcaggtgatctcagcactggctttgcctccccacgtattgggtgacctctggcaaatgtatgtcccccttccaggcctcagaggtctatttcagttgagggggtaaggtataattattctgcaaaggaaggtctaatcctgccactctgggatatgaaacagctcttctttgtgtattgggttcttgctctgagatgacatggggagcagaggcttggggtgagacaatgtggatccctgcaccactttgccccatccacgagcatctgagccatgatttttccctattgttcagaggctagtccgaacaactgtagggctttgacactagggtgtcttggagtacaggtgacagcagtacccaaacttctggcttgacaaatacaaaatacatcattggaggaaataatggtttctgttttttaatatttactctatttcctatacctagtagattacatgtattgtcacttatttttcataagtccctttcagatggccattatacatattttattttctaattttgtaaaaagattgaagctaagagagattaagtaaccattaaaagccacaaggttagtaagtgatagtaaatgatatttttattatatgctagcaacaatcagttagacatgctgcattttctattattaatatcaacaaaatcacaccattgctataaataaacaagagagaggcagagctttagaagagaaatctatgtaacttttcagaggcatataaaaatgcttgaatatacacatactcacaatacatgaatatgcacatatcacaatacatgaagactatgtggtgaagatgtcactatttactcaatatttaatatttatttaatttatccctaaggtgtattatacccaaaatccatttttaatatggtgtggttatggaggttaagggaacttgaaaccatacttaagtttatggggaagcataaattcttgtgaataggcgtagatgtttacaaatgaagattaaccctagggctctggaacctcctagacttaaaaaaaagttttgcaaagtaacaataatcaatatgttgtttttattagaagaatagtcaggttgagaaatcaatagaaaacaaaagaaaacccagaatcaggcctcattatatctaattcaggtaaagatcaatgtcaagttccaaaacaatgaagaaaacttgaattttttaagaaacaagattcagacggtaggttcactatttgcaaaaacaaaagaactaactctggtctgaattcaggcaaagattaagccactgagagagaaaaattgaaaggttccaaaaagacactttcttttcgctcaggaagcaggccaggatgacagtccatgcctagcaaggtagctgagcaactcaagatctcacagagaccagtggtttcttccatccaggatttgctgtggaacagagactgtaattcctttcatgttcagtcaggcagggacacatctcccaagaagaccctgccatttggaatagtcctctgactgcagtaggagagggtggagctgatactgggcccctcaggatctgctgtggcacagtggctggagatcccgatctcattggcttagaaggagtgcacatcttccagcaagttcctgcggagacgtaatagtttcctgattccagcagaaggagctgaagctgggaatggccccaccttgggatctgctgtgggatggaggctggagagtccatcttgttggccaagacaagtacatatctccctgcaagtctcagcaccgaaaggatagttcaattacagcaggaagtgtcagagctgagactggatcccatctcgacctgctgtgcaacagaggttggcaagcctgtcagggaggcttaggatcttaggctatgagatatgtgtgagtctccctctgggttgttgtgtgagcagctctgagctgggacctcagctgatgggggctggagctgaatcacaaggcaactttcagattcactgcccagtcagtgagcagaagggcctttctgccaaagccctagtgtatgtgattcattctggaccccacagcagatgggtttgattgcaggctcaaggccaaatgtaaccaaacccctgaatgggccatttctgggattgaactctggagccagctcagtggatcagccacgtgggtgttggtctgcactctcaatatgaccctccaaggtcttgggctccaccagagtttcacaaacttccccctgaatccagatccagaggctcccacagagagactttggactgtggatgagtgtagaattcttgtcattctggtgggacatgagcaggtgccttctatttcaccatcttggttatgtcattccttcctcagcagtttttttggtcgattttgcaaagctttaagttttacagtggggctggaaatagcaggagagtgtgagttccagccctgggatttgttgtttgctcccttttcactgacaggtattttgtatttttggcattctttgttttcaagttatgttgaggatgtggttttgtttagaaatttcttggtggtggtgttattttatacctcttggggtggagattgtggaagttacttattcttcctcttctgccttctattgtcttcaactaccccaaaaaaatctcctggaaactactctctgaaagaagttggagaaaaattattaatgcacttgaagaagatcaagaaaaaagaaagcgtgagtaatgttttgggtgagtttgaaagaagctatttttcttgcttccatttcattgcttccctctgcaataattccgggtgtgatccatgcattggatgtgtcctctagactcaaaccagatttcaaaagcagatatggggtaccagttctcctaacttcccaagcaatgagaggtgctgttactagggaagacagccttgtccaaggagtgctggaaccagacaagggcttggagacccaaggcctcaaagagagatacaaggccccaacatgtttcactttgctgtccctgcatggcctccctagagatattgacacctgattaacaaatcttgaatggcataaaggacaacaaaatgactgtggggagatgtcatttccctccttactttatcacgattgcacagacccctgaagggagaaatgcatttcctaatttcactcagtaagtcaaacccagaaaagaactggttctctgattcccagacatgggttcgttgtacaattgtctgaaaatagctgacttgatcaaattgtttcaaatgtaatttctataattccaattgatgcctcagtatttgtctcctaatacttggagtctttcattgttttccaattgtttagaatttcaaaggaaattattaattaatagaaataaggaattcacagcatgatgagggcccaatttgggagatgtgactttggaccaagtatctttttttttttttttgcgacatctaagcttggtcctgcccacctaggaggctgtgtaactgtgcagagaagggagtctttctacccacgttaacttatccagcttcaagtcccttccaggtaccctctgtcctccgattcccttctggaattcaggaacaggtagtactatgtcacctcccagacctaagtcttactcctaacagacctggataagttccctgttctcactaacctcagtaacaccatctggaaaagagaaggcctaagcacgtggagtttttgagcccctctaatagagcctccaaactacctagagcaagcttgtccaacttgtggcctgcaggctgcatgtggcccaggatggctttgattatggcccaacacaaattcataaatgagtttctttgtgattttttttagctcatcagctatcgttagtgttagtgtattttatgtgtggccaaagataattcttccaatgtgggccagggaggccaaaagattggacaccccaggccaggcgcagtggctcacgcctgtaatcccagcactttgggaggccgaggcgggccgatcatgaggtcaggagatcgagaccatcctggctaacacagtgaaaccccgtctctactaaaaatacaaaaaattagccgggcgtggtggcgggcacctgtagtcccagctgcttgggaggctgaggcaggagaatggcgtgaacccaggaggcggagtttgcagtgagccaagattgcaccactgcactcctgcctgggcgacagagcaagactccagctcaaagaaaaaaaaaaaaaaaaagattggacacccctgactgagagctttctaaggagaaatttgactatgtgggcaacttttgggaggaagtcagaagaaggggaaaaatgactggatttggggtccacctggcacatttaagtcctctaaaatgccatttgagtgagtcacagtggcttaatgagcttagcagacatcaagttttcaattacaagagaagacatatattctctgctctcctccctttgtttccaccatctggatccaataatccaaaacccagcagggttctggcttcttgtctgaggccagcagccctctgcttgtccctgaggctttatggtgattcccaagacggaacgatagagcagccactggtcagcctcaggaaaaatcaagccacttctcatgccctgtctagaactgagacagagagactctcctccaaccagtcatgtgggtcagccatctcaagggtaagcaggtgtcagccctaggaggtaaaaacaggcacctagtgtttatcagctcttagcatgtcccctgattacacagccttccatccaatttagaacaggaagtaccccttgacattatcacgaaccaccttctcacattaaggaggagaaaactgagtcccagagaggagaatgaaggtctttcagtcacagagtgctccgtagccttgctgggcctagaactaagatgtagcgctaacttcctaataaggtcactttgatggatccacttgatctgggccatgaaaggtggtccattggattgagcctgacagcctagagtgatggaacagcataaggtaatgtgtgaaagcaaaaacaaagagaagacactgcagatggaagcaatctggctgagataattttctacaactctgtgacaagtcagctattctcagtggaattttcagcacccccttattctctcattttaattatcttaactttctgtattttttattcttatctcacacgtttcaataaaatagctttatagtatcttttagcctctttcattgtggaaagggctgtaggagttttagagacaatctttctacctcattcatttttacgtttgttagaactgaattccagagataggaaagaatttgcctagtttttagcaaatccactgtgataccaaaaaaaaaaaaaaagccatggaaggccaggtgtggtggctcatgcctgtaatcccagcactttgggaggccaaggtggacggattacttgaggtcgggagtttgagaccatcctggccaacatggtgaaaccccgtctctactaaaaatacaaaaattagccaggcatggttgcaggcgcctgtaatcccaactactcaggaggttgaggcaggagaattgcttgaaccagggaggcggaggttgcagtgagctgaggtcgcgccaccgtattccagcctggtgacagagcgagactccatctcaaaaagaaaaaaaaaatgcaaaggaaacatgatgaattctgaacttgtatttagttttcagtgagatggtagaggtttcatattgattcagatgttaacctttccccagtgactgctttttaataccgtttgcttcctttcttattggattgtccagattatttcaatctatttgtaggagtgcttattatttaaatatgattcactatttgcttttatacattaacaaatatttttctggtgagttgttaactacagtcatgggtcacttagtgacaagtgatatggtctcagaaatgggttgttaggtgattttgtggcttagttatgcaatgcatgattttattcttttcctttgcttatatcatattttcccttccaaagattatcaatttttataaagtcaaatttttatcattctcaggaaatcctcaaatcagcattttacaaaaaaaaaaaaaacaaagaaaaaaccaaaaacctcaccagacttttaggacaactggagtcttggcggtccactctatgatgttcttgtatcttgcaccttgcaagagcatcataaggtggacttacaggaacctagatgtatagcttactacacagctaggcaatatggtatagcctattgttcctaggctacaaacctgtacactatgttattgtactgaacagtgtagtcaattgcaactcaatggtaagtacttgtgtatctaaacatatctaaatgtagaaaaggtacagtaaaaatatggtataaaatatttaaaaatagcatacctgtatagaggacttaccatgaatgcagcttgaaggtctgcaagttgattggtcttgtgaatcattaagtgaatggtaagtgaatgtcaagaactaggacattgctgtccattactgtagacgtaaacattatacacttagactacacaaaatttatttaaaagttttctttctgcaataataaattaaccttaacttagtataaaatctttatacacttttttatttttaattttttcactctttagtagtaaaatttagcttaaaacacaaacacattgtacagctacccaaaaatattttaaaaaaatccttattctataggctttcttccttttaaattattattttttccttttaaaacttttttgttggccagacatggtggcttatgcctgtaatcccagcactttgggagggcgaggcaggtggatcacgaggtcaggaggtcgagaccatcctggctaacacggtgaaaccccgtctctactaaaaaatacaaaaaatttgccgggcgtgatggtgggcgcctgtagtcccagctactcaggaggctgaggcaggagaatggcatgaacctgggaggtggaacttgcagtgagcccagatcctgccactgcactctagcctgggtgacagagcaagactccacctccaaaaaaaaaaaaaaaatacaaaaaaaactaagacacaaacacataatagcctaggcctgcacagggtcaggatcatcactatcactgtcttccacctctacatcttgccaggatcatcaatatcactgtcttccacctctacatcttgccacactggaaggtcttcgggagcaataacacatacagttgtcacctccggttataacaatgacttcctctggaatacagactgaagaaactgcctgggactgttttacagttgagttattttttaataagtagaggatggacactataataatgataaaaagtatagtatagtaattatagtaacatagtcgtttactatcattctgaagtattatgtactgtgcatgattgcatgctatatgtttatatgactggcagtggagtacacttgtttactccagcatcacctcaaacatgtgagtagtgccttgtactgtgacattaccacagctatgacattactaagtgataggaatttttcagctccattatagttttatgagagcaccatcacatatgcggttcgttgctgaccaaaacattgcctcatgctggagaagagtatccgagcatagttgctgcttcgagtcactccagggagatctaaaattccaggtgggagcattgtgtctactgagcatgtttagagatgggaaataatttgcctaaatttgtgatacaggaaatgaaatgataacatgataatttttaacttgtgtttaatgatgaacaaggcggtacacttttcatattgattcatgtgttaacattatttttccctgtgtactgtcttttcataccctttgctcttttttctactaggtgtccataatatttcaagtgatttgtaagagtgattcttatacaaagaaaacccaactcttgctctcatacatttaaaaatttttttctggttggttgttaaccattgttttagctagattatatattttaaccttacaaagtttttcaatttctataaagtcaaaatttttaaaaattcttacaaaaatattctccagttgggtattttaccagaaaaataaaaattcgccagactttgagggtagctagagttatggtgtccttgtgaatgtaaatctcccaaggtattcttataaagccatatcattacacagaagaatgagaaaacctcagaaacatcatttcttcagcaaaatctgaagtcagagaacagtaaaaacttcaaattatacagaaagaacatctgattttcaatggagagctctcttgaacttctgcctctacccttttcaaaggaaacagtggggtccagaaatatgtgtgtaaagaataggagagcctatgattgaaataaactcattcccaggaggatgtccacatatgaaaatacagagaaagagtcctggaggctcagagcatttgctagactttctgtgtgctggtgtgcagtccttgctgctgttaacactttactagggtgcatttgtcacaaggaatgaaccagtattgatacattattaactaaagtccagactttgttcatattgcctttgctgttaccaaggttctttttgtttcaggagcccatccaggacaatgtggattataattagtggtcatgtcttcttaggctcctcttggttgtgacagttgcacacattttccttgtttttgaagaccttgacagttttgaggagtactgctcaagtattttatagaatgtccctcaactgagatttgtctgatgtttttctcatactggggttgtggttttttggaggaaaacatcagaggtaaagtgcccttcttatcatgtaatatccagggtactgacttcaacatgatttactgttgatgatgttgacctagatgaccagtctgaggcagtgttcgtcaagtttctacactgaaaagtcaacttttccccctatccttgcatactatactctttgaaaggaagtcactgcacaaccatatgtaagatattccttaaaggggaagtatctaaataaattgtttggaattattctataaaaatgataattataattattgatgtcagataattgtttattatccctcatttatttacttactcaattgtttatttatatcagcgtggattcatagatatttattacatacattcgttataacttgttttgttgctgaaacagtaagaaggacgcttttgaacattaaaagccacaattctcagtaaagatattagttataagtatgtaagcactatatagcacagaaaacactttataaagaagaaaatatgagatacaccaaggagatatagataaaaacacagtaacagtaggagaattgaacacactgtattggtataagacaaaccaagtggacaaaaaagtaaacaaggatacagaggacacacccaggccttaaatacttatatcaacaaaaatgaaataagaagtgtaaataaatcaaattttcaacaaaagaagaaaaagagagaataaggccaaaaaaaagcaataataaagataaaagcaaatttttgaggtcaagaagagacaaacagtagctctaattaatagatttaaatgttgtttttgaaaaaattacaaaataggtgaaccatttgctgctatagtcaagatgaaaaggagtgaagaacagctaaataaaatcaagtataatggagggaatcaccaccaaaagagggaaaaaagaaagccctgagactcctttgtagaccaggttcctttctcacctcctggctgctgtgctgacccccaaggtcctgaggatgaggaggctgagcaagggacaaggccactggttgtcatctgtctgggcattgggtaagggctcctattctgtgtcttccctaacatacagcaggggctgtggatttcaaggatcatggtgaataatgttttagctttactaagcagggctccagacaaacatcataataattaaagggcagactctctaagtagcatgtctgcttagtcaaaagaagagatttattctaaatttttagcaggataccctgtcctgagtagggcatagttacacccaggaacgagaatgtgagtcctaccaccaggtaagccactgacatcagcagtgatcgtagctgaaggtgggagactttaaaatgagaatacaggagggtgatgatgagaaccagctgccacccacacaacaactgcagaggccacagctgttgtgtacccccttcccttccaccttcttatggtttatctcagagggagagcccatcagagcctgggagaagcttcccaaagtgtgtggagcccggatcccagcagtgccaggggtgcactgtggctgacagaggtactgcttggatgccccttcaaggagcaccttgttgcccagctgcatggagtgtggttagttaattgctgccagccactgctcgacctcaggcacaacctcagtttttgagctgagatcacacagaaccagggccctccagccaaaggcaaagtaaggctgtagtatgagattctacccttcatgcccaatgttgaacttctcttataaaaaaattcttgctcttgctcttgctccagagcttcctgttgggctgacagagatgttgtcaggacagtttggcaatggcatcctttgcctaatactgcttcctcacctttactttcacaggtgtgacctcacaaggcaacttgcattcttaactctgtctcagcccctgagaaccctgagcttgttggataacccaacctgcaaaacacagctcacagatttctgagaagcctgaagattcaggatcaggaccatagtaagatatgagtgtctaggtagcatgacaacagccagaaccacttctcaacaattgtgtgatgtgtacacagctgctgcagtcctggacactcatcactgccacccatgactctggaattgggtattgctgtggacaacaatactactttgttctgggaaagaatgccccttcatccttgcttctttgagtcactcaatggagattcaaggtgacatatgggaacattacatttgctgagcatgtttgtgcagccctaggcctcaggggtgaaggaaagtgccccctgttttgttctgtttttgcagtaggaacccagctctgtcactcagcaagtctcaaagatggccttaaatagggagatcccacaacataacaagggagttccacatagtggacagtcaaaagcatggacacatctcccataccgtggatcttcctagggttccaaactccccttgaaacttacacattggcaggtataaagtgaacagcacaattgttcacctctggaaatagaagggccactccctaatcaccatggaaatattcctaagaatgtgccttttcttattgggcagaaggccagatatctttttttatcagttttttcaatggcagtaatttatttcacaaggtcacctttaatgggcctgacccatttttctgcctatattttaatcacaggctgtatcttcagcttctccacactagatgataccttatcctcccagcctactgttcagtgtttttatgggcacgctcattcctcaacaatactggtcccacagtatttttctctccaatcacaacagagcataccactgctgcctccaggcatggcaacaccatgtctggccaccaacattgccaaattggacaccacttccactctcctcactggaaatagatgctgtagccatttatgccactgctgccggagtaaactctcacttcctaccacctccatgtctgcttttttctatcaccaattctcagtccattgcagtgtatacctctgactgtgtgaaccggtgcatatgcacatgtggaggctgccaagaagtcagagaaacaggcatgtggactttgcagcttctgctgggaatggtgtttgtaggcttagaggctaagacaggaaagttgcccacacaaccattctcatcccattgtgagcactggagcacctactatgcccctcctttccttcactctgtgttctagcctcagcttatgacctacagttttaatcaactgtaaaaaggcaatggagattggcaatagtagggacttcaccgcctcttgcctggattctctaatccacttacttccttgaaaaggcatttacaattctgtaatcatgaggggagatcaagaattatgagaaagatgagaagttcaggggctgcatgatattactgaaattacacagagactctaaaatggtaaatcaatgctcagaatttgcattgcagtcagaaaagatatggttattctgggatagctccactgctaccatgttcctcctagaggcacaatgttctctaacaaaacagtttttgctgagactggaaacactgataacatatttgcaggctgtgtgtgctccatgggggttgaaagcggggatcactaatgataatttttgaacaaccttcttaggccttccttgtccagtacctcctgggatggggacactctgttctagctagccatgtgtgtctgtcttttggagtccagagtgataagcgtcatgcacaagtaccaggtgcttctcagcttgtaacagattccaacttttcttgaatttgaagttggaaactccctttgaaatatccagacaaaaccccccatcttgtggatgggaaaaccggaatccagggatccatcaaagtttaatctagaaatcaggggcagagctggggctgggaactatctgttctaatatgatgtcattccctttggtagaatgttgaaaaagcaggaggattcattagcctttcaaaaaagactagttgaggggttaatttgccaaaaagcacagtgacaataggaattccaggaaaatagaataatccaagccaaaatgtggaatcaaagaaaaatatagatttgaggagaccccaaagaagtcagcaactcaactataaagtaaccctccacaatatgctaattctgccaccatccaggtcttccgcatcaccttggtgttctcacttgcggtgtgcccactgcacgagctttctgctattctactgcacattcacagctcacttggaagaaactttagtaagattcttggaatctttctcacagcaggaagagtcctaagagaccgagctactccttttacaataattgagacacagaccgctggcaaatgaaatttgccccaaatttggaagaccatctcataggcatgacaacaaaagactcatgtgtttgttttaacttggtgtggttttttttaattatgggggtagttttatttattttcaaatatgtagtagctacttgcattactttttaataaaccacatgttcatggtctatgtttatttttctatgagaagatctattttccttattgtgttttaaaaattctttcaatatattatagaatatctctattcccaccatatgtgtttatacattttaaaaatttctgttttcttactgtatgcatgattttccctgtaaaactttttatttgcttgtagttaatgatattaatttacttcagaaaatcattcacgtgtaaatattctacaaaacttgtctcatgtttactttgaatacttttatagttcgatctttatgtttaaatccttgaccacctaaaacgtactttgaaataatgggtggagtggaaatccagtatttactccttgaattgccggtaatcagtctaaacatcattcgctgaattactaacatttcttaagtgatgtggaattctgcccttatcatttgtaaaattctcaaaggcattgagtttatcttttattccattgagatgtgtgcattttctcaccattaatgtatgttctaattatgttgacatatttttgtgataattttggtggaattaaaatgtgtcatgggtaactctcccatgacaatttatcatcaatattttcctggaaaacctcaaatgcttactttatcagttggtatgttcaatttcattaatcattggatttttatctcatgggcttccaacttactcttcattgtttatcactaaaacccactaaaatctccatttttttttttttttttttgagacaggatctcgctctgtcgccaggctggagtgcagtggcgcaatcttggctcactgcaacctctgcctcctgggttcaagtgattcttctgcgtcagcctcctgagtagctgggactacagttgcatgccaccatgcccagctaatttttgtatttttaatagagacagggtttcaccatgttagccaggatggttttgatctcttgacctcgtgatccgcctgccttggcctcccaaagtgctgggattccaggcgtgagccaccacgcccggtctccatagtttttaagagcgccgttaggctggatattccttatactctgttcctaatactgtcagttccttagggaggactttggagctctctattcttatagcctgcctctcacttttggaaaatcactgagttccttctaaggagctgttttggaaagagtggttcacttttctcagagtgacagccctgctttaccaactgggctctgaccatgagccagaacatcctctgatgttgttggcaggcattcactggcatgaaaattctgcctggcaaatgagctgtgccgagggctatgggggtctcagcattcttgacctacaatgcctgggatagaacctctccactacaagtagtgttgggtggaagaatggagctctgtacctcttcatcacactcacctggaatctctgcaatacaaccttggaatgggtttgagagatgctggcaaccttttgcctctggtgagatatcataaccctttaaagggaagtgagaggaaagagactctcccattacttggctagatgtgccctgagtgaagcttccctcatattgagctaggatatagaaagtatagagtgggttatgactcaaatgctgtagacactctgtgttctttcaaggtttagtagagttttaaaaataaatgtatgcacttaagacaattcccaaagacttcaagtggctgttttaaaaaataacttttatcaagtatgattgtttggtttgagggtatttccatggatctccttacactgctattccagaggagaagccaccaggtcactcaactcttagtatcatctactggaaactggctaagacagtatttatgtgcttctctcacaataacaggaagataactatatcacacaatggatatggcagttggcttgactgcagtaatcatttaactatgtatatgtatatcaaaacatcatgttgcataccttaaatatgtacaataaaaataaaatctaaaagaaataaaataaaaataactttcaccagctgtggttgttggtttggagtaatccaaggaactcttcacaccattccctagcaagacttgcccaattattttcttcttaatttcaaagaagtctatttggctctgtgaaaatacaagtatctgactggttcacaaaaccactaggaaacctagaaattcaagttaaaagaaaaggcaaaaacaaagaagtcattgaatgcagaatcacagtcaaaattagtcagatattggcctttgtggagctcattggtgctacctcagagtagatggaggttacacatctctcagccaatatgccaaagccagatgctcttcaatgcatgggccatcatttccatttctcttctgagaagtcaaatacagctgccattgctgtaactgccccagaaatgaatcttcacctcctactatcactagctcccaagtgcagcccagagtttgtgcatctgatgatctgaacacggcatgtactcacataaggttgtctctcagtggaggcagggaaaacaagtgtccagactttcctattctgttataaaaagtggcagagcctctggatttcagggcttatgtggttaattcccccaaaataggaatgacattcttatgcttagaagccaagaaatgtctacaacacccacactcattacatcttgagtcctggagcaaggaacactttgtattttcttctcgcagattatattctatgtagccccatctgtgctaccaactttctgtaggatcttggacaatcactgtctgcttctgatgctcagaatacctgctagaaaaaaaaataaaataataaacaaaaaaaataagaagggctttgaggttagtgggccctctgtgcattcatgactatgatattccttgattatacagacacttatgcctcattcaggcaactatggattctttgttgaggacagatgaagaagggaaagaaagatgaagggttctgggaccacaaaaactgttttaaattaccaagagaaagcagatgcagtattctatgagatttgtgagtagagaagccagaaagtattattttaggcacaactcaactgataccaccctccaacaaatacctggagtcctctggcaacacagctttactgaaccaaggagcccagatagcatctctccaggctccggatgcaccccagggatagagcagtgaacgtcacagacgacctcaggtacattggagccgctctccagggccttgcagactcagttctagccagccatttgtgtctgtccctaggatcacagagtgtccaggagtcaggccaagccaggccctgaattctttccagattgtaataaatgtcctgagtcataatcttccattgaatttggagtcgaaatacctgctgacatatagaaaactgccctcatctaacaaaggggaatattgcttaggattgaggagtaaagctgaaaatgaaaaaaatcagtcctgatttcaagtcatttttctttccataggatgtagactaagacaggaagatgcaagcatcttgctcataaaaccattgttccatcagtttggcctgacgctgggtgagaggggtagggttataatagaaattccagaccaacagaacaatataagtcaaagtgtggaattacagtaaacatattgatttcagcattatttatgaccgcaaaatgttgggaacaaccaaaatacccatacagaaaagagtggttgtataaatgatagtacaactataaaatgaagtactgtgtagctattcaaaggtacacggaagatgtccatgaactgatgtatgttaattataaatacattgtggaatgataaatttaaagtgtcttataacaatgaatacaaaataagaaaatatccatttacctactcattgcaggaaaaaagaaaaaagaaaggaaaaacccagagaccaatgagagtggtcacctatgtggtcaggaattggtagaaaggaaagagagaatggagatggatatctgattcttctctgaatgtacctttatgcacagatctgactggggagccatgtgaaaatttcacatactcggatgaataaataaatgaataaaccccacaggattgagagataatttgtaatcaaatacaaactatttgtttgacaaaccaaccagcaaacaaataaaccatagatatgagaggaccatgaagattaaagaaacttccatttgcgaaaccattataaaacgtaatgaagatgaataaacactcattacagaatatcaaatcaaccattatcatgaggttttctttttttaatttttttattttattattattatactttaagttttcgggtacatgtgcacaatgtgcaggttagttacatatgtatacatgtgccattctggtgtgctgcacccattaactcgtcatttagcattaggtatatctcctaatgctatccctccccactccccccaccccacaacagtccccagagtgtcatgttccccttcctgtgtccatgtgttctcattgctcaattcccacctctgagtgagaatatgcggtgtttggttttttgttcttgtgatagtttactgagaatgatgatttccaatttcatccatgtccctacaaaggacatgaactcatcattttttatggctgcatagcattccatggtgtatatgtgccacattttcttaatccagtctatcactgttggacatttgggttggttccaagtctttgctactgtgaatagtgccacaataaacatacgtgtgcatgtgtttttatagcagcatgatttatagtcctttgggtatatatccagtaatgggatggctgggtcaaatggtatttctagttctagatccctgaggaatcgccacactgacttccacaatggttgaactagtttacagtcccaccaacagtgtaaaagtgttcctgtttctccacatcctctccagaacctgttgtttcctgactttttaatgattgccattctaaccggtgtgagatggtatctcattgtggttttgatttgcatttctctgatggccagtgatggtgagcattttttcatgtgttttttggctgcataaatgtcttcttttgagaagtgtctgttcatgtccttcacccactttttgatggggttgtttttttttttcttgtaaatttgtttgagttcattgtagattctggatattagccctttgtcagatgagtaggttgcgaaaattttctcccattttgtaggctgcctgttcactctgatggtagtttcttttgctgtgcagaagctctttagtttaattggatcccatttgtcaattttggcttttgttgccattgcttttggtgttttagacatgaagtccttgcccatgcctatgtcctgaatggtaatgcctaggttttcttctagggtttttatggttttatgtctaacgtttaagtctttaatccatcttgaattaatttttgtataaggtgtaaggaaaagatccagtttcagctttctacatatggctagccagttttcccagcaccatttattaaatagggaatcctttccccattgcttgtttttctcaggtttgtcaaagatcagatagttgtagatatgtggcgttatttctgagggctctgttctgttccattgatctatatctctgttttggtaccagtaccatgctgttttggttactgcagccttgtagtatagtttgaagtcaggtagcgtgatgcctccagctttgttcttttggcttaggattgacttggtgatgcgggctcttttttggttccatatgaactttaaagtagttttttccaattctgtgaagaaaatcattggttatcatgaggttttctgtactcctttggtgtctccatgcacagtgatcccaacctcatgtgctttgtgttgtgctcttgcaaattctctcttcaccaggcagagggctttgcttaatctgctagtccttgccacagcaaggacttcaagagactacatagtcccattttctcatcttacaatatctagaactgaggctggagatagaaggaacttgcccagaatcattactgggtaatcagcctcataagtgaaaagacaaattatactttatttaacttgcagtccttgaactatgaatgaagctataattgttttcatacatgcattaactgtttgtattataatttctctaaatacctgatggagctcatatcttacactctttattagatgatatgcccttctttatcacagtgaagaaattttttcaatatgctatgaaattcaccctttatctgatatatgtttattaatgttttccattttctgttcattactttttctttatctatggctggttttgcctcacaatttaaacatttttgtatagttttaaatttttttcaaattttattttagatacagggggtacatgttcaggtttgttacatgggcatattgtgtgatgctaaggtttggggtatagatcccatcacccaggtagtgagcgtagtatccaatagatagtttctcaacccatgcccacttccctctctcttccttctagtagtctgcagtgtctgttgttcccgtgtttatgtcagtgtgtgttcaatgtttagctcccacttataagtgagaacatgtggtatttggttttctgttcctgcattaatttgcttaggataatgacctccagctgcatccatgttcctgcaaaagataggatttcattctttttatggctatgtagtattctatggtatatacatgtcatattttctttatctaatcaaccatttatgggcacctaggttgattccatatctttgctattgtgcatagcaaagcaatgaacatgagtgcaggtgtcctttttgtagagtgatttattttccttttgggatatacccagtagtggaattgctgggtcaaacggtggctctgttttaagttctctgagaaatctccaaactgctctccacagtggggctgaattaatttacataccaactaaccaaaggggaaagaagatataagcattctcttttctccacagcctacagcatctgttgttttttgactctgaaattacagccattctgcaacagtcccctctggaacatcaacccagtggcctgagaactgttcctgtaccccagcacccacaggggctgctgctttctctgaattggaagactcagagtgcaaacctgcctgacccagcccccacctggctttgttctgccacctgccctggtagcttaatacaaaaaacagaaactcttggaagctctatggccccaactattgcctgagaaaccagagggcaatctaaagcaagcaaaaatcccactgctactaccatagctggtgcttttttgcaagcaccacctccgggctggaggccaaccaacacagtccattatagcatctcccggtagaataacactgcacctaggaaggagaaaatggctgaggaatctcagctatcaccactgcctgtacccctctgactaaccaggaggtactgattctgtccaagtgaccagttcagtgctactataaccagtgttcaagaaaaccaacacactaaggctatcaataaccaaggaatctcacagagtctgcatcactcccctgctaccctcatgactggtgtggctacccactgctgggagacttgaggacaggccacatcaccagatctcttgcagacattccccagtactggcctggagtgtggcaacttcactgggcagctagatccagaggagcatttgagaattctcagtgccctactctaaaagagtttgctgctatagtggcatgacatttttaggggtgagcttgcagggttatttctcaggtcagggttgtgtgcatgcagttggtggatcacccagttgtggtctggctcactggcattggaaccagggtgccatgataccaacagggaacatgggtatatgtttgctgggccagcatgaggcatgcctgccaggagtggcatatgtagctgtttctcagtctcaggacatggatgcacagctgctcagatagcctgaggtcacgtctgtcaggagcagcccactgggctgtttctcaggccgaagacatgggtacaaggctacttgggtagcctagtggcatgtctgctggaggagggaacagggctgcctctttggcctttgacacagctgcatggctgcttggctagtctttgggcatttctgtgaggggtggcacaagaagtggttttgttgtcccagggtccaagcatggggcttcttgttaggccttggggcatgcccaccaaggcagactgtggagttctttctcagtggtgagacaaaggcccatagctgcttggctggcctgggcatatccaccaggggtggccattggctgtttctcaagtttgggacatggactctttgctacttgggcagtctggggtcatgcccactaagggtagcttgtgggactgtttctcaggcccttatttaaaagattgggtcactgggcaagccatggatgtatctgtggagggcaagggtgctgcagggctgtttctcaggtattgagggaggaccatatcagctgcttggagctcaggggcccctcctgcttagtagagggtatgtggcagtttggctagttcaaggacaggcttacttggtacgactggacaattattccccagctgaaatgcagtggcatgagttggtttccctgctgtgccagaatagagtcacagccaatcctgggctcgaactctgcacagctggggttgtggagttcagccactatgtgaccttggcgtaatgaagatggagcccaaatgctggagaagtgtggttgtcagaagttccagaggaggctacactccagagggggctctgttgtcaagatgggactgtgctgcggcagcttggcccaagtgggtgagtgggatgtgggtagtgcacaccttgtgcccctaatgcagggcaatacagctgtgtgaattcccagcagctctccaaactgggctcaggactttaaaggactgtgggattctcctcttgtaaggatagtacatgtttgcagtcacaaggtgactggtggggaccttctccttacattttccctgcaacaggaagaccctcttggctccagacagatctgatccgagtggagggagacaggactgcaaaaaccagatgcctctgcactgccctcctgaacttctaatcaccacggttcatctccactcccccatgcactccagcactctccctttgacactccaaccaaatcttagctgtttgttaccttgaccctttattctggtggggatgagcaccatgggtctctagttatccatcttgctgactgccaaattttctatttcttcatagttaaatcttgatagcttacaggggtctaggaatttatcagtttcttctaggttatctaattgttagtatatagttgttcatgagtctctaatgatctttgcatttctgtggtatcagttgtaatgtctcctttttcatctctgattttatttaattgagtcttcttttttttgttttacttagtctagctaaaagtttggtgattttgtttgtcatttccaaaaaccaactctttgttttattgatcttttgtattgtgtttgtagtctccatttttattatttctactatatccgtatgatttctttccttctagtattattacaattagttttctcttttctttttcttattacttgtggtgccacattaggttgtttatttgagattttttttcttttttgtgtaggcatttattgctgtaactttctgtcttagaactatttttactgtatctcatagcctttgatacattgtgtttctactttagcttgtctcgaagaaatttttatttcctttttaatttcttctttgaccagttggttgttcaggagcatgtagtttaatttccatgtatttgtgtattttctgaagttccttcttttattaatttctagtttgatagtaatgtggtcagaaaagatacttgatatggtttcaatcttcataaaaatgttaagacttgttttgtggcctaacatataataatctattttggagaatatttcttgtgcagttgagaagaacatgtgttctggagttgtttaataaacttttctgtatacgcccttaaagtctatttagtctagagtgcagcttatatctcacaggtctttgcagattttctgtctgggtgatctgtccattgctattacagggttttgaaatcctctaatgatatagtttggatatccgtcccctccaaatctcatgttaaaatgtgaccatcagtgttggaagtgcagcctagtgtgaggtgtttgggttatagggctagatccctcatgaatggcctggtgctatccccgcagtaatgagtgagttctcactctcttagttcacatgaagactgcttgtttaaaagaccctggcatctttctttctccctctctcaccatgtgatacactggctcccaatcccttccatcacgattaaatactttatgtggcatcaccagaaactgagcagatgctggcaccaggcatcttagcctgcagaactttgagccaaacaaacctcttttctgtatacattctctagtctcaggtattgttttatagtaatgctaaatgccctaaaacacctactattattgtatgcagagatctctcttcagaatatttgctttatatctttaggtgcttggatttggggtgcatacgtacttacgatttctgtattatcttgctgaattgacctctttagcattatataatgatcttctttatgtctttttacatttttgacttaaagtctatttgatctgatataagtgttgctactcctgctctcttttggtttccacttgtgtggaatgttttttccatccattatcgttcagtctatgtgtgtaattaccagtatggttgcctcttttaggaagcctattgatgtatcttatttttttcccattcatccactctaggcatttaattagtgaatttatttaccttcaagataattattcataggtaaggacttactactgccactttttcattgttttctagttgctttggtgattctttctttctttctttctttctctcttattgccttccactatgattaagttagtttctctagtagtatattttgatacttattttttatttttagggcgtctattaaaaatgttgtctttgtggctaacatgaggcctttaaaaaaaatcctgtagctatcacaagtgattttaacctgataataatttgtttgattacaaaacataaaactacaccttaccaccacttccctccccgcattttgatattttcatgtcacaattaacagcttttatgtgccatatacattaacaatttattgtagttattattaatttcaagttttatcttttagccttcatactaaagatagaagtgatttatacatcaccattatagtatcacagtattctgaattttgactgtgtaattaattttattagtgagttctacacttttagattattttgtattactcattagcatccttttctttcaccttgaagaactcctttagcatttcttgtaaaataggtctgatggtgacatacttcctcacctttgtatgtctaggaaagttttcatttctctgtcatttctgaagaacagctttgctgagtatagtatgcttggatggttttcttttttttcattactttgataatattattccactctcctctgatctttaatgttccctttgagaaatatgatttgattgcagcactattcatactagcaaaaacatggaatcgacttaggtgcccatcaatggtggattggataaagaaaatatggtgtatatacaccatggaatactacacagtcataaaaaataaataaaatcatgcatttgcagcaacatggatgcagtgggaggccattatcctaagtagattaatgcaggaagagaaaactatataccacatgttctcagttatagaggggagctaaatgtcagatactcatgaacataaagatggaaataatacacactgaagactactagaggagagaaggagggagggaaggggacaagggttgaaaaactaaatgttgggtattatagtcagtatcagaatgacaggaaaattcataccccgagcttcagcatcatgcaatatacccaggtaacaaatttgcacacttggcccctgaatgtaaaataacagttgaaaaagaaaaaaaaggtctgatgtgaagtgtattggaactgttttgcattttatttgcttcttttcttttgctgcttcagtatcatttatttgtctttgatctttcacagtttaattattatatgtctagtcttttttgaattgaatgtgattggtgactgttgaccatcctgcactttgactacatatatatatatataatagacacatacatatatatataatatatatgtatatatgtatatgtatatatatgggtgtatatatgtgtgtgtgtgtgtgtgtgtatatatatatatatatatatatatatatatatatatatgaactcctcagatttggaaagttttctgttattacttatttaataagctttctttacttttccatttatctttctctaacttctcttgaatgccagtaaattgtccctttgctcacttaatgctattccatacatctcataagtttccttcattctattcttttttcttttttccttttctgagtatatattgtcaaataacctgtattcaagctcacagattattccttctgcttgatcatttctggtgttaatgcactctattgcacttttcacacttttcattttattcattgcattcttcagctcctatattaacattagatattaaatgttatcatttttaccctttgttacatctctctttctggtcacttattgttttcatcatttcatttaattatttatctgtattttattaaagttctttgagcttccttagaacagccattttaaattctctttcaggcaggtcatacatctccatgtctttggggccaatcaatggtatcttattttgttcatttggtaccttattttgttaatttggtgtcatcagttttccccgattgttcttgatccttgtgattgtgcattgatgtctgcacattgaagaagtaggtacttattgaattgcaggtaggtacttgaatgcagatattgaatttaaggtaggtacttactccagtttggctttgtctgagaatgtccctcaactctgtccggaaattctaggcagatcatctgttctaggtttgtaagcctgtgactgtttcagtcattgcagcacaaggagatgtcataaacccaggaccaccatggccagttctgcaccaggctgtaacccatggctgcagaggctggcacaatgatggaatgcattcccaactcctcctcactgatacctgcctacgtatgttggttattcataatccaaggctgctgtagttggctgccagtggtacaggtaagaacgcaagtctatctcacaggaactatgtgttcctctctgctgctggggcaggtcttgctgcttaggccacaggtattcaagcagggtcactatgggtgtcctcccagtgctgaattttactattatagactagtattttgttccgtgaaaaagtccaagccttacttcattcccttccccccaaaagaaagtagctctctctgcactgtgctgcctgtgattgggttaggggtgatacaggaaacaaaattgtctttcgtgccctcttcaatgtgtatttttaattattatactataatcaggttctgtaatatctcatctggcctgtttagcttttgagaaactattatcatatgtggataattattaaattcgacgttttggagggtataatctctggggagtcctactctaccaggtttttctgcccattccccaaaaataactatatttgaatcttttctaagttgtaaagtgatttcccatagaattgagcaaaatacatttaagtcctcctgttttcttcttttcctatgagtataaaactttcagatttttgtgccaatttagtgcactttaatatttttgcattttttatttgtccaacaggacaaatcatttgatcacttaatcttttcccccatcataattccatatctaagatgtatgcatcaccataccatttttatgctttccaaatcactgatttctgatttcaactttatcaatacattcctttatcatttggaaatgtttttttccacatttcattgaattcaattctaatatgaatatagtaatcacatgttttgcttggattgcattttcctggtttgtttttgcaaatattgtgcccttttgttttatctgcatcttttggacactagatgagatgaaagttttgttcttgatccataagtaagattaatatttcagactctattttgtatcagtaagtttggaacagaacagtttctggtattttcttaagggaagtgtgaggaagattacagtggttagcagacacagtaatcaattttagttcagaacaatatcaccttactctgttggggtttctgcaataaggaactacttactgcctttgaggcaaacagataaatttggtaagatctcagagtggctcatagagaaaccatgcagctcacatgatttatgtttgatagcatagcactttttttctgtggttggcctttctcttttccccttccatagagcattgcctacaggaaggttaagattctaagacagaataattgaaaataagttttcaagctatcctttccccagcactaccctccaaggtgttctgaatgtacacagggacactgttgggatgctttcttcttctcctgtggtctgctcataacgaagtctttatgactcaaagtaaagaaagtttcttcagacttttcaggatgtcatcacaattggaaaaatctatgcttctaccaaaggtgggaattttagcttcatgtccactcacaatacattattcaattcattgatggtggcaaatatttctcacagcctgtttggggattcagctgtttactactgaagtagaaacttctcttaattaaaaagaaaattctgctgtttaggtagatttcatgaaaagaacccaatctagaaaccagcatttttactttttttccaacagttgttcctatcaccatgaaagcatattaaaattctttcatcctttgaaaacacatctggaacttacctcaccctccagatacagcctcagctctcactccaccatgaattcagacttcctgagaaggttgcagctggtctccatccttcaactgacaacccaatgcaattgtattcatctctcattaaagttactagcaacaactaagaaaaactttggatacatgtcagtctttattgtgttgaacttgacagacatatttgacattggagtgccccatttacttgtttaaaatttctttctttggattccataacgtttcattatcttctatatcattggacttctatgattgctcattcttaggtaaaatagaacgtgtctcaagatcatttttaaaacaaaaggaagtatggagttctatctaaaatagagtatttaaattattgcatcatgaagggaaactcacatttagaatataaaggcattctcagaaaccaattgcttttgtagcctgaagccagtctctttcctacttttgtctataattctgtaaaattaaagtgatctggcatgatgatctaaaaggactgataaaaatttgctggggctgccagaagaaagaaaatgcctttgacattatgttgctggggacattgactttgtcccacactcagcaggggtgaggaagttggcatttactgataagctaagaaaagtcagtgccttttgtaatttaagctccacccatggcacactcactcaaggaagatataaatgacaaggtcggctcagctctcagacaaggttttccaagcaagatgaagcccaacatcatctttgtactttccctgctcctcatcttggagaagcaagcagctgtgatgggacaaaaaggtgagtggagagggtaagccttggggaaagctgctcagacagctaataatctaagattatttggggtgcaaacagtaacctgtttaggcacagattcttctctttgaagagaattgattttctccacccaaagcttcagcttttctagaaatatcaataatttgttgggggaaaagtggggggtaagagttgtaagggagctttggagataatgaatgcataccttcttattatcaattaccaggtggatcaaaaggccgattaccaagtgaattttcccaatttccacacggacaaaagggccagcactattctggacaaaaaggcaagcaacaaactgaatccaaaggcagtttttctattcaatacacatatcatgtagatgccaatgatcatgaccagtcccgaaaaagtcagcaatatgatttgaatgccctacataagacgacaaaatcacaacgacatctaggtggaagtcaacaactgctccataataaacaagaaggcagagaccatgataaatcaaaaggtcattttcacagggtagttatacaccataaaggaggcaaagctcatcgtgggacacaaaatccttctcaagatcaggggaatagcccatctggaaagggaatatccagtcaatattcaaacacagaagaaaggctgtgggttcatggactaagtaaagaacaaacttccgtctctggtgcacaaaaaggtagaaaacaaggcggatcccaaagcagttatgttctccaaactgaagagctagtagctaacaaacaacaacgtgagactaaaaattctcatcaaaataaagggcattaccaaaatgtggttgaagtgagagaggaacattcaagtaaagtacaaacctcactctgtcctgcgcaccaagacaaactccaacatggatccaaagacattttttctacccaagatgagctcctagtatataacaagaatcaacaccagacaaaaaatctcaatcaagatcaacagcatggccgaaaggcaaataaaatatcataccaatcttcaagtacagaagaaagacgactccactatggagaaaatggtgtgcagaaagatgtatcccaaagcagtatttatagccaaactgaagagaaagcacagggcaagtctcaaaaacagataacaattcccagtcaagagcaagagcatagccaaaaggcaaataaaatatcataccaatcttcaagtacggaagaaagacgactccactatggagaaaatggtgtgcagaaagatgtatcccaacgcagtatttatagccaaactgaaaagctagtagcaggcaagtctcaaatccaggcaccaaatcctaagcaagagccatggcatggtgaaaatgcaaaaggagagtctggccaatctacaaatagagaacaagacctactcagtcatgaacaaaaaggcagacaccaacatggatctcatgggggattggatattgtaattatagagcaggaagatgacagtgatcgtcatttggcacaacatcttaacaacgaccgaaacccattatttacataaacctaccattcggtaaccatgtgaaaggatggaccaatatcaaggtaatttttttttagcaaataggggagatatctctctcattgtttagaattgttggggactctccaggacttttgtgggattgataaccattgttcgcaccaatagaagtgctgtataacaagtggtaggaagatgagcctccccattccctggtgaggagagggtctggtagtggcacagaaggatgtttggcctatcatgaggtcctagaattcctatccttaattgaatattcttcaataatatttttttgtatatgcctacctgctaaaggtttttttgaacaggtactgactacatatgcatatttataagtttatggtatactcttgtcagttcttatactttagattagtaaacctcagtttctttcctatatagtataaaggattacagccattaatgttttctttctgcacaccagtgaatgttcttgcatccctgttagggttcatctatgctccttcagagaccacaagcccaaagactatcagtcctccctctcagaatacaggaaagagatatgtagaaagatccttgttcatgttgtgaaagagaagatggaaagggagacacaagagatggtgagggatctcatgggccaattgggtgtttacaacatcaggagaagaaaactgaagccctgagaggggtaatggtgcttccctgcctctttgcagtaagtaacactgcacttgaagagagggcaagcagtagaaacagtggccccagctggcaactagtggcctggtatcctagtagtagagggctggtacagttggagctgaaggggacagggggcccagctaccatccccacccttcactttttactatactcacatcactgattctcttctttctctctaggtgtcagttgacctcagtgaattctgtgatgtttctgagatgcagactcccgtgtagtttcagattcttggtccatggatgacaccacctgcccatgcttccttgaattaggctttcctaacctgaagcgccttcaaacttccaataaagagatcattttctgcttcatctgcttttgactcctgttttctctggattcctagtggctcaaggggttgagggcatttctaatgtaagtggttttgaaagaaaataaagggatatttttgaagcactagggagaatagtaatcaaagccacatttcaagatatattgatagaaaccaacactaaaaatagggtgctgttagtctaccagtcacatgtctaccacctgaggccaacactaaaggctttcatgaccctggtactaataagaccccaggaactaaaaatatcccagaaagacaagagaaaatgtattgcaacaggccctgggaaagtccctgatctgctggtgatcaattccacagtagcacatcccttcaattagcttaagaatgtcttacgcctacagtatccattgagatgcaattacaccaaaggtgatatgttaaatctgcacaacttcagtaacagcaagtgggttaaaatgtcacctgtggatggaaagaccagatgaccagtcaaaggaatcttgaggcaggtggtgtcttcataatggaaatactgctgcctatactgccttttccccctctattttaaaaaagtttccagagaaatctaaaccttcaggagaagaggccaacataggggagtgagaaaatcacaagcctaagaataagagatttggattgtagttccaattctgccataataacctgtatatctttacctaaatatgttcttccctgcaagcttaagtcccacatctgcaacatggaaaagtttgacacagcaatcttcatagtacatattgactcaaaattgtagacattcaaaagaaagaaagaagaaagaaagaaagagagagagagagaaagagaagaaagaaagaaaggagagagagagagacagaaaggaaaggaaaggaaagagggagggaaggagggaaggaaggaaggaaggaaggaaggaagtaagaaggaaggaaaaagaaagaaaggaggtcaataagaccttaaagacggtgtctaatgctgcagtaaatttggtagggccagaataggtcagatggacatgaatgcttcagaatgacacaggcctactcggagtagagattggtactgttgtccaccctcaaaaccatggatcatataggcccagagttgggttagcctgggccccacatacaacaaccaaggagccataagtttattaagagtcatgacgtcttccaggagaagcaaatcattccctaagctagccaacagcttgaaagtcagtaggtcagcttcatcaaaagagccaaaagagtaggtgtagttatgtttgtccatcaccacagccaggcagccggttatgtgtgtattatgaagtcataaaatctaccaagtatgtcattgctaagaattagtatagatcagccaataaatatgtatgtggttgtgctgtgggcccacaggtacccatctccacttctcacacacatgcagcacacgcatacagggctgaatggcccctgtgctacaatagcttggtgaggaagaaattgtagagaattagcaattgcttaccataaattctccttttagttctatttctttggctgtatgactccagcaaagcatttgttgttgttttctttgcctcataggtacaataaaagtattgtttcctgatggaagaaatagaaagaaagaagaaagaaagaaaaagaaagacagaaggaaagaaagaaaaagaaaggaagaaaggaagaaagaaaggaaggaaggaaggaagggaaaaagggagaaagagtgaaagagagagagaaggagagagggagagagagtgggagggaagggaggaggggaggaagggagggagggaaggaaggggagagagaaagaaagagagaaagagagaaagaaagaaagaagcaagcaaataaagaagcaagcaaagaaagaaaaagaaagaaagaaagaaaagaaaggaaggaagaaagaaagaggaagggagggagggaaggaagaaacaaaggaaggaaggaaagagagagaagaaagaaagaaggaaagaaagaaagaaaggaaggaagaaagaaaaagaagaaagaaagaagcaagcaaagaaagaagcaagcaaagaaagaagcaaggagagaaagaaagaaaggaagaaagagaggaagggagggagggagggaaggaaggagggaacaaaggaaggaaggagagagaagaaagaaagaaagagagagagagaaagaaagaaagaaaggagggagggagggaaggaaggaagaagaaagaaagaaagaaagagagagagagaaaaaggaagaaagaaagagaaagaaagaaagaaagagagagagagaaaaaggaagaaagagaaagaaagaaagaaagaaagaaagagaaatctccatcaggtcttaatgtcttcatgttgcctgtaggtgtgtgattagagactttgtcatagtggcatgagaactctgtctctcttcactgctaccttcccaagagaatagagaccttgtgctcagccacctgctctattttcccagcccagcagttagaaaggagaggttatgatgggcctaggagccttagcatcagagaagctagaattacctgctacagtctgctgaacagattctctcctctaagtatggacagaaatacattacacagtttccctgacatgttgctgattgcatgggagagggaaacataaattgacatgcaaacaagcaaaagagccagagtcataaatgctgtgtgctgtggtacaattagcacgaactttggttcccaccacttgcatagtcttgggccacaggatctctgatactgacctcctgcctcttaatgaggggatataataatgatctcataaagatgcttagatgtattgagtgagatgatcacagcccaagtgctcagggaaaagtgccagaatgacaacaaatttggaaataataataataaaacaatcttttattatatgttctttgaaatagaggtaaaattcatacaaagaaatgcacagatcttatatctgtttgaatgagattgacaaacacatacatgtggttgcacaacacctagatgagcatatagaacattaatcttgccttatgcccctttcaaattcactccaagcccttcaggggcaaatgttatactgacatagaaactaataacttgcttgtttttaatccttacataatgaaatcatataataacattaccttttgtgtccgactgttattcaatgtttgagattcattgtttttgtatgtatcagcagttattttattgttgaataatattacattgtttgagtctccatatttgttcttccatttatctgctgatagatgaacatttggtgttcccaattgagcgattgtgaattaagatatcacataaatccctgtacaaggcacaataacatatatttttaattatccgtggtaaatacccaggagtgaaattttctcccagtgtgtggcttgggttttttttttttttttcattttcttaatgatggtgtattcagaagagtagaagttttaaagtgtgacagaatcaaatatatctattttccctttaaattgaatattattgtgtctaagaactttggccttctcgaaggctgcaaaaatgttctgtttgtgatatctttccctagaagcagcataagtttagcatctatattaaggtttatggttcaaattgattaatatgtgcattccatgcaaggtacagatcaaggttcctttcttccaagatgctcttgtttttactaattattaataatgctgctatggacattcatgtgcaaatttttgtgtgaatacattttcagttctctttggtataatcatggaagtggaatttttgggtcacatggcaacactgtttaactcttgaagaaactgacacactgtttttacaatgactctaccattttatagtcccaccagcaacagcttcttagatgtggagattaatattgttaagcaaaatcaaaatgtttttagccattatatcttcaaatatcctctgcctcattctctcttctgaaattcccattatgcatatgtttttacactagattatgctccataggtctttgaagctctattcatttttttcattctttttttttttttcactgtttctcagagtgtataatctcgattgacctataattatgttgggtttttcttctgtccattcctacctgctggtgagcccctctggtgaatttctatttcagcgattgtactttacaacttcatcgcttatcttgaattatttcaatattgtgagacatgattttcatacttttctttagtctttttctccatgatttcctttagttcttggagtataccagctgatgtcatgatacatgctcatggatgagtagaatcaatattgtgagaatgaccatactgccaaaagcaatctacaaattcaaggcaatccgcatcaaaataccaccatcattcttcacagatttaggaaaagcaattctaaaattcatatggaaccaaaaaacagcccacatagccaaagcaagactaagcaaaaagaacaaatctggaggcatcacactacctgatttcaaactatactataaggccatagtcaccaaaatagcgtggcactggtataaaaataggcacatagaccaatggaacagaatagagaacccagaaataaacccaaatacttatagccaaatgatctttggcaaagcaaacaaaaacataaagtggggaaaaggattcccttttcaacaaatggtgctgggataattggctacccacatgtgggagaatgaaactggatcctcatctcacactttatacaaaaatcaactcaagatagattaaagacttaaaactaatacctgaaactataaaaattctagaagataacattggaaaaatccttctagacattggcttaggcaaggatttcatgaccaaaaggcaaaaagcaattgcaattaaaacaaagataaatagctgggacctaattaaactaaagggcttttgcacagcaaaaggaacagtcagtagagtaaatggacaacccacagagtgggagaaaatcttcacattctatacatctgacaaaggactaatatccagaatttacaacgaactcaaacaaatcagtaagaaaaaacgatcaatcccaccaaaaagtgggctaaggacatgaacagacaatccttaaaagaagatatacaggctgggcgcggtggctcatgcctgtaatcctagcactttgggaggccgaggcgggcggatcacgaggtcaggagatcgagaccatcctgactaacacggtgaaaccccgtctctactaaaaatacaaaaaattagccgggcgctgtggccggctcctgtagtcccagctggtcgggaggcggtggggggggagtgctgaggcaggagaatggcgtggacccgggaggcggagcttgaagtgagccgagatcgcgccactgcactccagcctgggtgaaagacaaagactccgtctcaaaaaaaaaaaaaaaaaaaaaaagaagaagaagatatacaaatggccaacaaacatatgaaaaaatgctcaacatcactaatgatcagggaaatgcaaatcaaaaccacaatgcaataccaccttactcctataagaatggccatattcaaagaatcgaaaaaccgtagatgttggtgtggatgcggcaatcagggaacacttctacactgctggtgggaatgtaaactagtacagctgctatggaaaacggtgtggagattccttaaagaactaaaagtagaactaccgtatgatctagcaatcccactactgggtaaccacccggaggaaaagaagtcattattcaaaaaagatacttgcacatccatgtttatagcagcacaattcacaatagcaaaatcctggaaccaatccaaatgcctatcaatcaatgagtagataaagaaactctgacatatatatatatatatatatatatatatatgagttttatatatatatgttttatatatatatcagtgtttcatatatatatatataatctttctttgtctttgactttcagcaatgcaattaaaatgtgccttggagagaacctgttttatatatatatgtatatagatctctctctcaccatgatgcccatatatgtatatatgatggaatactactcagccataaaaaggaatgaattaacagcatttgcaatgacctggatgagattagagatgattattccaagtgaagtaactcaggaatggaaagttaaacatcatacattctcactgatatgtgggagctaacctatgaggacgcaaaggaataagaatgataaagtggactttggggacttggggggaagagtgggaggggggcgggggataaaagataaaagacaacaaatatggtgcagtgtatactgctcaggtgatgggtgcaccaggttcttacaaatctccactaaagaacttactcatgtaaccaaataccacctgtaccccaataacttatagaaaaataaaattaaaaaaataaaggaacagggaaaactaccttcattagcagacaatacatatgcaaaaaattccaaagcatcaactaagaaaccatggaacctaataaatgaaatcaccaatgttgcagaatacatgattaaaagataacaattggtcgtatttctatacattgatgatgaaaaattcaaaattaaaattcagtaaacaattctatttagaatgtcaaaaaaaccaaaatgcttagaaatataaattacccatgacatgtaaatcttatacactaaaggctacaaaacacttccccaagaaagtaaagacctaaataaatggatgtagatcctttatttgtgaaatggaggacttaatattgttaagatggcacactacccaaagtgataatcaaatcactgcaattctctctctttttcttttctttttttttttttttttttgagatggagtctgactctgtcgcccaggctggagtgcagtggcacgatctcagctcactgcaacctcggcctcccaggctcaagcgattctcctgtctcagcctcctgagtagctgggattacaggcgcacgctgtcatacttggctaattttttgtattttactagagacggggtttcaccgtgttgcccaagctggtctcgaacttctgagctcaggcaatccacccgtcttggcctcccaaagtgctaggattacagccaccgtgcccagcccgaatcaatgcaattcttatcaaaaattttatggctttcttgtagaaatggaaaagtgggttctaacgttcatttggaatttcaagggatcccaaatagccgtacaatcttgactaagaggaacacagttggaagactcacacttcacaaatactatcttataacccattatttaaactgacaacaacttaacactgcttccataaacaaacaagagaaagaaaactaataaagactctatactttaacttcattcccgccactttttaactgataattgctgtgctttctctcaccccatgcacagaaatgctctgtgccccatacctgcaaccgggagatgaaggaggagtggcatcagtgatacaagtgtttttcctaccccttcagcgcctctttcagtgatataaagttaaaatcagttactgtgagtgctcacctgattttttggttcttataaaggtgatctttctctgcagatacttgttaaattggtgaccttggtgggggcaggggggatcattggagccttctattccaccatcttgttctgccaccctcctctcttaatttttattctctctgaacgattttatttctccttcatttctgaaggatagctttgctgagggtaatgttcttagctgacagttttctcttttagtaatttgaatatattatgccattctttcctggcctgtaaggtttctcccgagaaattctctgttagtcagatgggggttaccttatatgtgacttgacatttttctcttgctgcttttaaaaatctttctttgtctttgacttttagcaatgcaattaaaatgtgccttggagagaacccgtttaggttgaatttatttagggttcttatagcttcctggacctggatttctatctctctcccaagatgcaagaagttttctgctattattttatgcgtctgatggaaaagttgcctcttccaattttatggagtagattttataagcgaaaacttatttttatgaatgggtctttaggtgttagttcatttgagtttgttggtttttgttgcaggtgtatgtagcagtattgtttccatagagtttcttcacctatgatccacacttgtggcacttgagagtttctcagcgccctagttgagagagtgtgctgctacagtggcatggctttgccagtgctgtggttccagcgctaattctcaggtcaggggtgtgtgcatccacgtggtaggtaattcaattaaggtatgactcaatggtattggggccagggtgctgttatcctggctggaagcatgggcacatgtttgttcagtcagtgagtgtgactacaggctaggggtggcctgtgaagctgtttcttggtttcaggacgtggaagtacagcttctcaactggtctgaagacatgtctgccagggtcagtctactgggctttttctcaggcccaagatgtgggtgtaaggctgcttggatggcctacgagaggaagggaatgagagaggaaagagggctttttctcaggcacttgacacagctgcatggctgagtggctaggctttgagcatttctgtaaggggtggcccaagaagatattctgtaggcctagggtgtaggcatggagcttcttggttgtccttcatgtgtgaccaccagaggcaatctgtaggactgtttctcagacctgggacatgaccacataactacttggctggcttgggtatgcccaccaggggtggcccatgggctgtttctcaggtttgggaaatgggctctcggcagctgggccagcgtggtgtcaagcccagcaggggagcttgtgagtctgtttctcaagctcttattgggagtatagggccactgagcaggccatggatgtgtctctggagggagagagtgttacagggctatttctcaggtactcagtgtggacacatagccactgtgctgccacaggggcatataaactgtgtcaagctcagtgacctgtctcctacttggtgaactttaaaatattctactattttttccttgtttattttttatcatttgatattttcccaatcatgataccacatctaagatgtatgcagcactataccatgtttatgctttccaaattaccgatttctgctttcatctttatcaatagatttatttttaattttgaaatgcttttttttcaaatttcattaaatccaatcatgatatgagtatcataatcacatgttgtgcctagtttgcattttcctgctttgtttttgcaaatcttgtgcacctttgttttatctgtatcttttggacactagattagttggaagttttgttcttgatccataagtaagattaatatttcagactcttgtttgttccggtaatcttggaacacaacagttcctggtatttccttaagggaagtgtaaggaagattatagtgattagcaggtacagcaataaatttgtgttcaggaaaactttactcttttcttttggggtccctgccataaggaaatacttactgcccttagggcaaacagataaaactggtaagatctcagaatggctcatagagaaaccacatagctcacatgcttcaagtttgatggcataagtagcattttttcctatggttggcctttcccctctccccttccatatagcattgcttacaggaaggttaggattttaagagagaataatagaaaataagtttccaagccgtcctttctccagaactaccctccacagtgttctgaatgcatacagggtcactgttcaaatgttgctgcttctcctgttgtcttctcataacaaggactttttcagtcaaagtaaagaaactggccgggtgcagtggctcatgcctgtaatcccagcagtttgggaggctgaggcgggcggatcacgaggtcaggagattgagaccatcctggctaacacggtgaaaccccgtctctactaaaaatacaaaaaattagccgggcgtggtggcaggcacctgtagtcccagctacttgggaagctgaggcaggagaatggcatgaacctgggaggcacagcttgcagtgagccgagatggtgccactgcactccagcctgggcgacagagcgagactctgtctcaaaaacaaacaaacaaaaaaaacaaaacaaacaaacaaacaaacaaaaaaccttccttggatttttcaagaagttttcacaattgcaaaaaaacaaaacaaaacaacacaacacaacaaaacaaaacaaaagcaaaaaaaccctatgcttccacccaaggtaaaaattttagctttaggtccactctcaatacattatttaatgaactgaagttggcaaatattcctcacagcctgttggagggttcagcagtttattacagaagtatgaaatgcttttatttaaaaaatgtattttggtaaatacatttttgtttaggtaaatatcatcaaataatccaatttggaaaccaacattcttacttctttttccaacagttgttcctatcatcataaaaacatgttaaatttttctcatcctttcaaaaaatctctggagcttacctcaccctccagatacagcctcacctctcattccaccatgaaatcagacttcttgagatggtttcagctggactccatccttcaactgacaacccaacacaactgtattcatctctcgttaacattactagcagtgagtaacatcagaaagtttttgacacatgttagtcttttttgtgatgaacttcacagatacatttgacattggtatgcctcatttatttgttgaaatttttttctttggcttccatgaagtttctttctcttctgtatcattctacttctatgactgctccttctcgagtaaaacagaatgtgtctcaggattactttaaaacaagacaaagtatagagttatacctaaaatttagtatttaagttattggatcagaaaggaaactcgcatttagagtatgaaggcattgtcagccaccaattacttttgtaacctgaagctagtctccttcctactccggactgaatttcttctgtataatgcaagcgatctggcatgatgatatacaaagaccgataaaattttgctggggattctgaaagtaaaaaaaattgcctttgatattatgtccccatgctaagtccctggggactttgacattatcccccactgagcaggggtgaggaagctggcatttactaataagctatgaaagggcagtgccttttgacatttcagctccacccatagcacacccactcaaggaacatataaatgaagagatccgctcagttctcagacaagatttttcaagcaagatgaagtccatcatcctctttgtcctttccctgctccttatcttggagaagcaagcagctgtgatgggacaaaaaggtgagtggagagggtaagccttggggaaagctactttaaaaaaatggcctctaaggatattcagggtgcaaacagtaacctgttcaggcacagattcttctccttgatgagaattgatttttctccacccaacgctgtaggcttttggaaatatcagaaatttgttgggaaaaggtgggaggtaagagttgcaagagagctttggagataatgaatgcatacatttctattatcaattaccaggtggatcaaaaggccaattgccaagcggatcttcccaatttccacatggacaaaagggccagcactattttggacaaaaagaccaacaacatactaaatccaaaggcagtttttctattcaacacacatatcatgtagacatcaatgatcatgactggacccgaaaaagtcagcaatatgatttgaatgccctacataaggcgacaaaatcaaaacaacacctaggtggaagtcaacaactgctcaattataaacaagaaggcagagaccatgataaatcaaaaggtcattttcacatgatagttatacatcataaaggaggccaagctcatcatgggacacaaaatccttctcaagatcaggggaatagcccatctggaaagggattatccagtcaatgttcaaacacagaaaaaaggctatgggttcatggactaagtaaagaacaagcttcagcctctggtgcacaaaaaggtagaacacaaggtggatcccaaagcagttatgttctccaaactgaagaactagtagttaacaaacaacaacgtgagactaaaaattctcatcaaaataaagggcattaccaaaatgtggttgacgtgagagaggaacattcaagtaaactacaaacttcactccatcctgcacatcaagacagactccaacatggacccaaagacatttttactacccaagatgagctcctagtatataacaagaatcaacaccagacaaaaaatctcagtcaagatcaagagcatggccggaaggcacataaaatatcatacccgtcttcacgtacagaagaaagacaacttcaccatggagaaaagagtgtacagaaagatgtatccaaaggcagcatttctatccaaactgaagagaaaatacatggcaagtctcaaaaccaggtaacaattcatagtcaagatcaagagcatggccataaggaaaataaaatatcataccaatcttcaagtacagaagaaagacatctcaactgtggagaaaagggcatccagaaaggtgtatccaaaggcagtatttcgatccaaactgaagagcaaatacatggcaagtctcaaaaccaggtaagaattcctagtcaagctcaagagtatggccataaggaaaataaaatatcataccaatcttcgagtacagaagaaagacgtctcaacagtggagaaaaggatgtacagaaaggtgtatccaaaggcagtatttctatccaaactgaagagaaaatacatggcaagtctcaaaaccaggtaacaattcctagtcaagatcaagagcatggccataaggaaaataaaatgtcataccaatcttcaagtacagaagaaagacgactcaactatggaggaaagagcacgcagaaagatgtatcccaaagcagtatttctttccaaattgaaaagctagtagaaggcaagtctcaaatccagacaccaaatcctaatcaagatcaatggtctggccaaaatgcaaaaggaaagtctggtcaatctgcagatagcaaacaagacctactcagtcatgaacaaaaaggcagatacaaacaggaatccagtgagtcacataatattgtaattactgagcatgaggttgcccaagatgatcatttgacacaacaatataatgaagacagaaatccaatatctacatagccctgttgcttagcaaccacttgaaaagctggaccaatagcaaggtaagtttgcttttcttaccaaataggagaggtgcctgtcccaaagttggggactctccaggaacatggtaggactgataaccattgttcacatcaatagaagtgctatattacaagtggtgggaagatgaacaccatttcctggcgagtagaggacctggtagtggcagggaaggctgcttggactatcactgggtcctagaattcctattcttaattgagtattcttcaataatatttttatacatgcctacctgctaaagatttttttgaacatgcactgactatatatgcatatttatgagtttatggtatactcttgtcaattcttatactttagattagtaaacctcaaattctttctcatatagtatgaaatattacagcagttaatattttctttctgcacatacatgaatgttcttgcatccctgttagagttcatctatgctccttcagagaccacaagcccaaagactagcagtccactctctctgaatataggaaagatatgagtagaaagaaggattcctgttcagattgtgaaaaaggaagtggaaatggaggtgcaggagatgctgagagatctcaggtgctaactggacacttgcaatgtcaggagaggaaaattttaacctggattggggaaatggttcttccatgcccctttgcaataagtaacactgtacctgaagagagggtaagcagcagaaacaatggtcccagctgataactagtgacctggtgtcctaatgatcagggggctggtgcagttgacgctaaaggggacaggggtcccagctctcccatcctcacccccactctccactatcctcacatatctggttgtcttttttctccctaggtgtcacccgacctcagtgaagtctttgatgtttctgagaggcagactcccatgtggtcccagatccttggtccatggatgacaccaccttcccatgcttccttgcattaggctttctaaacccggagccccttcaaacttccaataaagggatcattttctgctttatctgcttttggctccagtgatctctgaattcctagtggctcaaggggctgaggtcatttctgataaaaatggttttggaagaaaagaatgggatattttttaagcattagggagaatagcaatcaaagccacatttctagatgtattgatagaaatccaacactaaaaacaagatgctattactctgccaggcacacatctacttcctgatgccaaccctaaagtctctcgtgacctctgtactaacaggaccccaggatctaacagtcccccagaaagaacagagaaaatgtattgcaacaagccctaggaaagtccctgatctactagtgccatgagtattccccaagtccacagcagcatatctcttcacttagcttaagaactgtcctactcctacagcatacatttagatgcaatcacaccaaagagtgatatgtcaagtctccaccacttcagcaagagtgagtggatttaaaaatgttatctgtgatggaaagaccagacgaccaggccagagtcttggggcaggtggtgtgttaataatagaaattctactccttttatgccctttcaccctttattctaaggatgattccagggaaagccaaacatccaggagaagaagccaacatagaggaataagaaaaatcactagtctaggaataagagatctggattccattctagctctgttttaagaactagtatatctttaattaaatcttttctttcctgcaagcttaagtcccacatctgcccatgaaaaactttgacacagttaacttcatagtacatgctgactaaatattgtagagcttccttaaaaagaaagaaagagagagggagggagggagagggagaagagaaaaagagagaagacaaaaagagagaaagaaagcaaagaaagagaaagaaagaaagaaagaaagaaagagaaagaaagaaaagaaaagagaaagaaagagatggaagggaggaaaaaggaatgaaggaaaaagaaaggaaggaaggaaaataaaggaagggaaagaaagaaaagagagagagaaagaagaaagaaaagaaagaaagaaagaaagaaagaaagaaagaaaaagaaaaacaaagaaagaaagaaagagagaaagaatcttctctatgaggtctgatattgcttgtaggtgtgtgataaaagacttggtcatagtgttatgagaatcctgtctctcttcactgcatccttcccaagaacacagaggccctgtgatcagccacctgccttattttaccagcccagcagttaaagaggagaggctgtgatgggcttaggggccttagcatcagggaagctagaattacctgctacagtctgctgaacagactctcttctctacatgtggagagacatacattcaacagtttccctgacatgttgctgattgtgcagggaaggaaacctaaattaacatgcaaataaccaagacagccagagtcataaatgctgtggctgtggtacaattagcttgaaatgtggatcccaccgcttgcatagtcttggaaagtggggtctctgatgcagagttccttcaccttaacgtggggataataataaccatctcatagacgtgcttaaagatattgagtgagatgatctcaaccccagtgctcaaaaaaaaaaaagtgccaggacaacaaatttggaagtaataataataaaataattttttattatgccttctttgaaaaggaggtaaaatacatataaagaaaagcacagatcttatgtatttgcttgaatgagatttgacaaacacatacatatgattgcacaacgcctagatgaacgtatggaacattcatcttgccttatgctcctttcaaattcagtcccagttcttcaggggcaaataatatattgacttctagaaactcataactcacctgtttttaatccttacataatgaatttatggaataacattaccttttgtgtatcgctgttattcagtgtttttgagattcattctgttttgtatgtatcagcagttcattcattttattgctgaatagtattccattgtttgagtctccacatttgttcttctatttatctgctgataaacatttggtgttcccagtttgggtcactgtgaattaggatatcacataagttcttgtacaaggcacagtaatatatatttttaaatatctgtggtaaatacctagaagtagaattttctcccagggtgtggcttgttttgttttgttttgtttcttaatgatgatgtatttggaagagctaaagttttaaagtgtgatgaaatcaaacatattcattttccttttaatatgaatattattgtatctaagaacttttgccttctccaaggctgcagaaatgttctgtctgtgatgtccttccctagaagctgcataggtttagcatctatactaaggtttatggtccaacttgattaacattcgcattccactcaaggtgcagatccagattcctttttcgcagatgctcgtttttattagttattaataatgctgctatgggcattcatgtgcaaatatttgcgtgaatacattttcagttctcttgggtataattatggaagtggaatttttgattctggtgtgctataaggttctaactatattattttgcatgtggatatccagttttcccagtatgatttgctgaaaagatgactttttctactgaatagtttttctacccttgttgaagataagtgaattgacaatgtaatggttgatttttggactcccaattctattcctttgatatatgtgtctatgcttatgctagtaccacactgtcttgacactgtagctttgccgtaagtgttgaaatatggaagtatgagtcttctacatttgcactctttttcaagattgtggttgctattctgggttctatgcatttacacatgaactttaggattaacatgtcaatttctacaaaaagtcatctgtaactttataggaattccatttagtttttagataaaatatggaaaattgcctgcctaagaatattgagtcttcaatccacaaacatggaatggctctctatttttatgtcttctttaatttctttcatcatgatttgttgttttcaacaaatgtacatgtcttgccattattttcttaaataaattcctgtgtatttcattcttttcgatgctattgtaaatggatttttttcatgatgcaattgaaaggtataggttgatattttgtcctgcaccttgatgagttgtttattagctctaataatattttggagttatgtggattcttaaaagttttctacatatgtcatcatgtcagtatttcatgtatgggaaatctaatggtgaaaaacatgaagtattcatatatctgggagtaccttaatttttccctaacttgtgaaggatagatttgccaagatatagaattcttggtagaccgatatttctttcaccacttttaatatgttctctcactatcttctggcttgcatggttctaatgataaatcagctgttaagcttatttattagtcattttgagttatttatctcttgctgctttcaagaatttctcggccaagcgcggtggctcatgcctataatcccagcactttgggaggctgaggtgggcagatcatgaggtcaggagttagagaccagcctggccaacatggtgaaaccccgtctctattaaagatacaaaaaattagctgggcgtggtggtgtgcacctgtaatcccagctactcgagaagctgggacaggagaatcgcttgaacccaggaggcggaggttgcagtgagccaagattgtgccattgcactccagcctgagcgacaggatgagactgtttcaaagaaaaaagaatttatttttgtctttgtcattgatatttccattataaattgtctaggtgtggatctcttacagttttttcttagtgttcattgagatttttatacatggagatttgtgttttaaagcaaaatcaaatgtttttagccattacatcttcaaatatctgtctgcctctttctttctctctcctttcttctgggatttccattatgcacatgtttttccattagattgtattacacaggtctctttctttatcgttcctcagagtgtataatctcaattgacctataattatagtagttgttcctctcttctgtctattcctatctgctggtaagaccctcttgtgactttctgtatcagcgattttactttacaacctcatcattcatcatgaattttttttatgatgtgaaactgatttttatactttctgttaatctttttgcccatgatttcctttagttctttgagtataataactgatatctttgtccactaggccattgtctgggattcctaaaggatcatttctatttattgtttcccctcttttctgtgtatgggcagtatttcatgtttctttaaacatctcataatttttaaataaaattgtactttctacgtaatataatttggcagctttggaaatcagaatctatctttagcatttgtttgtgtggtttttattgctgaatacttgcttagtaacattcctggactaattttgtaaagtctgtgttatgcatcgtgtacagccactaaattccctgtttcgtttgcttactagtcagataatgaatggacaccaatgatcttaagtcctgtaagccataagttggccttttgactttatcaactagtgaagttttgacacagtcatgaagacattaagacatgaattaaatgagaaaaatttttcacgaattaaacttaaagcctgtggtgcacaaggaactagatttttcataaatctagaaattatcttgctaatagatcaatatctggctcttactttctgtctgtgtgtgtttcaatgttaatgtagtaaaagtaaacacttcaaatgcacccttatctgaacatggctgtgaggagtcggtttcaaatgttctggatacacagtgggaagagggaaattggtcagtcctgatgcagtccctgggaaaaacaatgccctcctattacctaaaaattcgacagtataaagtaagaattaggaagagccaggacagttctgcaacaccccgaaaaaaggaaaatccatgggggctctgaaaaattacaccccagaagttgtttcacgtggttgcttcctggaagtgaaagaaaacagctggtgcttccgggtcaagttgaggcacctctgatctccagcccccggagccacagcaccacctgctggtggggccccgctagagctgacatagacaggtccagcctccaggtgcgcccaatcccttttcttgcattatgaagctaagcagcctctctcaactcactgtgaccgtccccctttgcctcctccacatggcccagcctggagccctgaaaagtggcgggtagggcgtggcgacgcgtactgtggctggagttggggagcatttcctctgaggagtccatgcgacgacctggccctcatgcctggaagtcacttggtgtccccgactcaccctgtggcatttttctccagctgcacagaaacctgaatgttgcccagagttttctgttgcctgccctttcatcctgttacccatgtgctggcaggataaaatttgcaaaggggttaaatggtgttgctactacgaacgtcggcattagtgtatggagtcctgctggactttggattgaggttaggagccccagatctgctgcccgtgaaaccttcctgcagaagcattgtcttagaaggagttgagaacttcatgttcccctagaaaatcgttgtgatcagaggttttaaattgggtcgacccatagatctgcctctggacaatgaagcaagacctccttgcttagattatgcaccttccatttcacacaacggacttcacccttctcctctctgtaaagaggatatttcagcaagattcattaagatcctcaacagttaccgggtttttattattttttattcctattttctacagcttataataatgaaacactttcctcttcatatttacattgtgagtgtttatataatttcacacttccttaggatggcttgcctagaatccctgatccccgtccttgattcctggatagcacatgccagtgttctttggagaatacataagaggatccagacaatggcgtcctattgcctcaaaatctgctggatgaagtaaaaatgatgaagagttctgtaacaccctgaaaggaggcagtccatgagggctctcagaagttacatcccagttgtttcacgttgtctcttcctggaggtgaaaggaaacagatggtgcttccgggttaagcggaggcacctctgacctccagccccgggagtcaaaacgccatctgttgatggggccccgccaaagctgacatagacaggtccagcctccaggtgcccccacaccgttttcttgcattatgaagctgagcggcttctttctactctctgtgaacatcctcctttgcctctgaatgacccagcctggagtcttgaggagtgcaggtagggcctggcgaccctgggtgtggctggggttgggaacgtttcctctgaggagtccatggggtgacctggcctggaaatcacacattggtgcccactcatcctacggcttttttttttttttttggagtctcgttctgtcacccaggctggagtgcagtgacgagatctcggctcactgcatcctccgcctcctggatttaagcgattctcctgcctcagcctcctgacctatggcgttttttccagctgcacggaaaccgggatattgcccagagtttgatcttgactgccctttcactctcttacctatgcgctggcgtgataagagttgcagggggtcaagaagtgttgctactacaactgtcggcatcagtgtatggagccctggtggactttggattgaggtgaggagccccagatctgctgttctccttgctgcccctaactccttccctcagaagcatttgtcttagagagaactgagaacttcccatgcgtttagcaaccgttgtgagcagggcttttaaattgggtcagtccacgcatttgcctctctaaagtgaaggaggaggctcaacagacctctttgctcagatatgcaccttccacttcacataatgggcatcactcttctcctctctataactctctataatgtcgacatttcaacaagattatctctaaggtactcaatagttactggattttattatttattttcaaatccttttacttacagtttacaatcatgaaacattttcctctttacatttacatcgtgaggtaagtttataatttcacaattccttaggatggcttgcctagagtccctgatccccagtccctgactctttggcagcacctgccagtgttcttgtgaggagaatacctaacaggaatcacgcctcaatgcccccgggacacaaaaccatgtgccctgtacattttgcatcttcctatatctctggtttcctgttctctcccaagatggaaagcccttcttaaccaggactgaggagacacaagtgctacaggctcagtctgggataactggtctccatgttgtccatgatcgctcaggcccagaacttccttttagcaagagttaaatgcttcttactatgataacaagacgaagaaataaagcgttgtatatttaaaactctttgaaaatctaagtctgctggattgatctcttgctctccctctctactcagccatgttgcataatcccttaggaactgtaaaatggacagagttactgtttcacatttagtttcatcaattcctgcacttgtgtttttctgatatatttgtctctttcaatatctcctgacactcagattctctgttggtcagattccaggtgcattttggagttaaattctctgggtttgcatcctatgaatggcatgccgattaatcctgtaatggaagagcaaggcatttttgcttcagtttttctggtactactgctggtggcctttccaagtgttgaagtaatatgatctgcgattggatttggaacttagggtcagaaactgagcaagatgtactttagttctaggtactttcattcctaaaaattgagccaccctaaattaggagaacaaaatccttgtggttcagcctacatcccttgagtctttgcttgagggttgggccctaggtctacctaataatgaagtgtaattagccatgaattttccaaatttataactctgtgcttcattcttccttaactcccacaaatgttgcagaggtctgggaaagtaattttccaaaattttatttatctctgacaagtatcttaacaattttgaaaaactactttttcccaagcatgttttaaactgacatctaataattttatcatcattgcatagtttcaagagataaaaatttaggtatatgataaatgttgtcatttaaatcaaatgggtatcttactctatgaggtttctaatagaatctaactacaatgttcatttgttagtaacatctattagggaagaaaaaaaacatgtcctttttcctcatcatctctctatctttcacatcagagaggagctaccctctctgcaagagcttcgaagagagaagctaccctttctgcgagagcttcaaagaccagcagacatccgaacaccctgcctgcagagaggagccaccctctccagggccccctctctgttgagagctgaatactcaagggatgatctgcctacagagagtaacaacccactacaggtctcctctgagctcttctaacactaaataaagctcttcttcatcgtcttcacccttcacttgtctgtgtaccttattctttctggatgcagaacaggaactcaggcaaaggtgccaccagccacagaggtttctggaaagaaaatgaacaccccaaagatcatgtaacacttctactaatttgggtttggcttgttcttgcttttctagttttttgagatgcattgttaggttacttatttgatatctttccagtttttttatgtaggggcttattgctattaacttgcctcttaatactatttttgccatgctccataagtttcgtttttttgtatttctacttttgattgtttcaaggaatttttaattttattcttaatttcttttttcatccactggtcattcaggagcatgtcgtttaatttccatatattttgtatagttttgaatgttcctgttgttattgatgtctagttttatttccttgtggtcatataagatacttgatatgattttgattttttaaaattttttgagacttcttttgtattttagcacttggtcaatcctggagaatgtttcatgtgcagatacaacaaaagtgcattccatagctgctgggtaaaatgttttgcaaatgtctgttaagttcatttgatctatagtacagtttaaacttgatgcttctgggttaattttccatcttgattatctttccaatactgagagtagggtgttaaaatccccacgtattattgcgttagagtctatctctcccttcagctctaataatgttcaccttatatatccagatgctccagtgttgggtgcatatatatttataattattatgttctcttgctgaattagtccctttactattacataatgttcttatttgtccctttttccagattttgacttgaagtctattttgtctgatattagtatagctactccttcttgcttttggtttctgtttgcatggaatatcttttccataccttcaattcaaccccatatatgtctttacaggtgatgtgagttctcgtgggcaggacacagttgagtttaggtgttttacccattcagccagtctacatattttaaatggtgaatttaatccatttatattcggggctgttgttgaaaggtgagggcttaaacctcttattttattgattgttttctgattgtttcatatatcttttgttccttacttcctatcttattgtaagttttgggctgggttgttttctgtggtgacaattcttgattcttttctcttcctcctttgtgtatcggctctgccagtgagttttagagtttcttaaactttcatgatggtggcagttgtcttctcacttccagacatgactctcttgaaaatattttgtaaagccagtctagtggtgatgaatccccttagctattgcttatctatgaagaattttatttctctttcatttctgaaagataattttgctgggtattcttgtccactagttttttttttcttttagtaatttgaatatattattccattctcttctggactataaggtttttgctaagaaatcctctgttagtctgatgaggatttcattatatgtgacatgatgcttttctcttcttgttttaagaattctttctttgtctgtgacttttgacaatttgacaatagcgtgcctcagaaaggacctgtttgggttgaacctaaatggggtgttttgagcttcctggacctgtatgtccatctcactgccaatacttgggaagttttcagctatttttaacatgttatttatacattttccattctcttttcttctggaatgcccgtaatgtgaatacttgttcacttaattttgaacaaatggtgtccccagaatcctgtaggctttcttcatttatttttattcttttttatctttttgtctgctgatattatttcaagtatcctgtcctctagtgtagaaattatttctactctgttgttaaagttcacagttgtatttttttattttattcattgaattcttcaactctagaatttttgtttggtacatggctgcgtggccagcctgggagtgttcctgccaggggtagcccatgaggctgtttctcaggcccaggatgtggtcacacagctgcttggctgacccgggtgtatgtcggctgggggcaacctgaaagactgcttctctgtcctggaatgcaagcacaaggctgtccagctggacttgggggtctgtctgctggaggtggccccagagggctgcttcttaggtctaggatgcagggcacacagctgattgaccctcctgggggcatgtctgccaggggttgaccacagggctgcttctcaagcctggattacaggtgcaaggctgcttggctggactcagtgcatgtctgctggggctttctgtttctcagccccaggatgtgaattaatggctgctcagcccacctgaaggcttcccctggtgaggaagcctgtggtgttgtttctcagtcccagggcatggctgcacagctgctcatgcagcctagggcatgtctgccaggggcagcccacaggtctgtatctcaggccctgattgtgggtgcagggccattgggtaggccaggggcttgtttgagtgggtggggcaccatggaaatgtttctaatccctagacatggatgtgtacctgcttctcaggccttggaatgtgtcaacttctcagaggcctgagcaccactttcactcagaggagggtgtgcagcagtttgactggttcaagggcaggtttaccctgtgcgggactgtcatgccattcctccaggcggaagtgagggcagcgggggttgtttgttctacaggaccagagtcacagccagtcctgtatccacacttgatgctgctgggattatggcattcagccactggtgtgggcctggtggaatgaagaccaagccctgttgagggaaaagtgcagtggctactgggctccacaggagggcgcactccacaggtggctctggtctcaagatggcacctgctgcagcatcttggctgacagtgggtaggtggactatgaggagtgcaccccttgtgctttcagttcaaagcaatgcacctgcatgaattcctagcagcgtttcaaacggctcagggcttgtgtgtgagtactgcaggattctccgtagtaaggattttaggtgtttgtggtggtagtggagactagtgcggttcttttgcttaccttttccccacaataggatgtcctcctgactccagatagatcggatccaggtgtggaagacagggcggcagatgctggatgcatccatgctgccctgctagacttccaatccccacaggtgcatctccactcccctgctatattcgaatactcttccttggactctctaatcgagtttcatcagtttattcattgctttggtactttcttgtggggagaatgagtgcctgtcttctatagtcagtcgtcttggtgacatcactgagctaaatttctttatactgcatatcccatcctgaattattggagtcttttttaaaataatttttattcttaaccttcatactaaagatatgatttgcataccaccattatagtattagagcattctgaatttatgtaattacttctactactaatgagttctatacttttaatttttttattgttacacatgagtactctttctttcatcttttctttagcttttcttgtaagagagggttccccatccgccccccacccccactcagcccacatagcaggaggtgagcagagagtgagtgagcgttaccacctgagctctgcctcctgtcagatcaggggtggcattagtttctcataggagcaggaaccttattgtgaactgtgcatgcaagggatctaggttgcatgctccctatggcccccactgccccgccccaccaccccctccctccccacccctatccatggaaaaattgtcttccacgaaatcagtccctggtgccaaaaggtttaggatcactgttgtaagatatgcctgttagtgatgaagttcttcagcttttgattgtctaggaaagtatttctccttcatttctgaaagacaacttttctgggtacagtatccacggataacagttttttttttcttcatcactttgaatatctcatgccactctccttctggcctttaaggttcctgttgagaagtttgtatgtaggtatattggaactcccttatatgttatttgcttcttttctcttgctgctttcaggatcctttctttgtctttgatcttttatagtttgactattatatgtatgtctggtattttttggactgaatctgattggtgacctttgacctttctgtaccttgatatatcagggggtttgctagggcctgttgcaatacatttctctggtatttctgagagattgttagtccctaatctactggtgccatcaattccacaaatccacagcagcccaacccgtcacttggttcaaggactgtgctcctcctacagtatccattaagatcttaagatcttgtaccagcgattgatgtggcaactctctaccatttcagtaagcatgactgggtaaaacaatctgtgaatagacataccagaggatggtctaaaagagttttgggggttgggaagtcttaaaatggaagctctgctgcctatactgtcttcttcccctctcctaagaaagtttccagggaaggataaacctctaggagaagaagccagaatgggagaatagaaaacctttggactggggataggagatctggattttagttccagctctgccataagaacctgtgcatcttcaattaaatctgttttctctccaagcttaagttcctcatctgcacatagaaaatttggtgtagtaattctgatcatgcgtgctagcccaacattctgggagttcatttaaaaagaagaaagaaggaaagataaaataaagaaaggagagaaaggaaggaagaaagaaagaagaaagaaaaaaggaagaaagaaggaagaaaggaagaaggaaggaaacaaagaagaaaggaagagaggaggaaggaaggaaagagtgagagagaaagaaagaagaaggaaggaaggaaggatcttctctatcagatctaaattttgcctgtaggtgtgtggtaacagacatcatcacagtggcatgagaacctgtctccactgcactgttccctagagcacggatgccctgtgctcagccacctgccttatttttccagcccagcaattgaagaggagagaccatggtgggcttaggggccttagcatcagggaagctataattccctgctagagtctggtgacaagattctcacttttatgtgtggccagagatacattcaacagtgttcttgacacactggtaatggtatggagtcaggaagggtatctaaattgatatgccaacaagcaaaagagccagagccataaatgctctgggagaatacactcaagaatatgctggttattagcaggcgaacaattaaaattttggatctcctagcaaagttaacagttctatacataaatgtacaattagcatgaaccttggttttcaccacttacatagtcttgagcagcaaggtctctgatgctgaacttctgcatctttttcttttcttttcttttttcttttttctcactctgtcacccaggctggagtgcagtggtgtgatcttggctcactgcagcattgacctgattttcccacctcagccccctgagtagctgggattacaggtgcacgccaccatggccagctaattttttgtatttttagtagagatggggtttcactatgctgcccaggatggtcttgaactcctgaactcaagcaatctgcctgtctcggcctcccagagtgctgggattacaggcatgagcccccacgcctggccagacctcctgcgtcttaatgtgggaataataataaccatgtcatatagattttcagaggtattgagtgagattatctcagccccagtgctcaataaaaagttccagcatgacaacaaatttggtaataataataataaaacaatcttttattatatcttaatattgaggtaaaatatatacaaagaaaagcacagatctaatgtatttatttgaatgagatttggcaaatacatatgtgtagttacacaaaatcatatggagatatagaacattctcatcaaccttgaaagttgtctatgacgcattcaaatttaattccaacccttcaggggcaatcattatgctgacatctaccaatttaagacttgcctgttttttctcatttaagaagcatttattgttataaatgcactcaggcactgtaagacataacataaatgaaataattttcagataaaagcaactgcttattattttatcctgcctttatattatttttataaactgccttcagaaggtatcattcattaccataccagttgggtggtctgtaatatattcccacaaggtttgtcttccctttatttcttcttttgttcttacaaacatgtattctacagtgttgctgcttctaagttcattgattttctcttatgtattattttgatatgcaatgctttttttttttttgagatggaatctccctcattgtgtcacccaggctgaagcgcctgcaacctccacctcccaggctcaagtgattcttctgcctcagcccccaattaggtgagattacaggtgtgtgccaccatatccagctactttttgtatttttagtagagatggggtttcaccatgttggccaggctggtctcgaacccctgacctcaagtgattcgcccatcttagcctcccaaagtgctggtactacaggcatgagccaccatgcccactcttgatatacaatgcttcttaacccccttcctaataagatcatttctttttaacaatgtatataatattctggactgaagttcaatcccacaaattatcagtgatgataacaatttataattaccattcttggttaaaatctcaacttaacatgagcattggcacaaattctataaacaagccacttttaaaagccccaataaagttgactatataattaaagtgacctagttcaaatagaaacaagtgacagtagaagtgaattaatattatatgtgctacatggtagtgtagttatgatactcataattttgtattgccattgtagatattttcttctagtgctttcaagttaccaacagatatttatattcaagatttaagaaaaatatttcagaattcccaggaattctttaaattaaagttgttcttaaagtttatccaacattcttcacactgcttactcattatagacatggtttgatggttaagaaacattgagtttatcacatttacaaagaactgtaggttgtgaatattcatactctcagaaatatgctagttattagcaggtgaacaattaaaatttcggatctccttagcaaagttaacagttctatacagaactgtaaaccaaaattgccaatttcagaacttatttgcttccaaacttgttatttcctgaaacaccactcataggatttatatatatattcacttgtacgtctattaaaattaattttatttgcaagaatgactcactattagtagcatacagaatgataagcatatactcctaatgtggcaacaggtacaagcaacatgattagatggtgactgctttttccttagtgctcctgattcattctctgaacacattgaccttaatttttggctctacatgtcagcattttctggtctttgctttagacttctaaccagcaatgttactattttgaatcccaaggtttaattcttacaaaagaatgtaaagactataatactttttttttttttttgccaggcacagtggctcacgcctgtaattccagaactttgggaggctgaagagggtggatcaccctgagatcaggagttcaagactagcctgaccaacatagtgaaaccctgtctctactaaaaatacaaaaattagctgggcatggtggagggcacccgtaatcccagctactcgggaggccgaggcaagagaatcacttgaacctgggaggtggaggttgcagtgagctgggattgcatcattgcactccagcctgggtgacaagtgtgaaactccatctcaagaaaaaaaataaaaataaacaaaaacactggccaagctctcaatgttaagtagaaatggtgaagacagacatccttgccttctcctaaccttaaggagaaaacatccaatattttaccattagagatgatgtttatcagcggcataccaaggattgtggcagtgggagtggttcatctgaggaggagggagtgtttatctctgactctgtttaaaattgccagcacatagtgataatatacagtacagctttttaagccacttttattattattcttaaattctctacaattgggggacctatttattgcttacaactggggtgaactccttccaataacctccttccacttcagtacaccactaagatatgctttaagttgaatatagtgccctttatcatattgagagggagagcttctcttccttgcaggtggagaagttttataataaatgggttttggatttgtcaaatactttctctgttgagatgatcatatagtgaattacactgactaattttaatacaaaacatatcctgaatgtgtgtctcatttgaccttaatgtataatctatttaacatatttttggactgagtttatgactacttggttagagatttttatgcctatgtctatgaaggatgttagactgtaagtaaacttttttataatgttcttcccaggttttagtatcacagttatcttaggctcataaaagaagttgggaagtgttttctctgcttctcttgtcttaaaacatttttgtagaatgtataatttgtagatgtttaatagcatttacctgtgaagccacctggaccagcagtgtactttttggaaaggtttttcattaaaaatttgattgctttaacataggagtcaacaaacttcagcaaagagccaggaaatgaatattgtaagttttatatgccttaagatctttattgcaactccttgtctgtaccactataggacaaaggcagtcaaagatcattcttaccaatggatgtggttgtatgccaacaaacttcacttacagaatcagaagtggtaatctagtctcccagtccaggaatcaaagcaagtgtgtttaacttatatttgtttagttattcagttaattatttgtgctactttcttattgagatacaatttacaaaccatgacatgcaccttttaaggtgtacaatatagtggttttcagtattttgataagcttgtgcaaccctcaccacttgttaattccggaacaacttcattactcccatgaagaacccctatacctgatggcactcaatccttcctcctacctttacttctcccttggcaaccactaacctgctttttatgaattgacttattctggacactttatattaattaaagtatataatatgtggctcattgcatctgacttctttcatgcagaattatgttttcaaagctcatccatgttgtagggtgggatcttttttttttttttactttttatgtatgaataatatttcactgaatggatacatcacattttgtttatccatttatccattggtgaacatttggatgtttctagtttgtatgtactattattaatcctactatgaacatttatgtgcaaattttgtgttaaaatgttttcaattaccttgagtataattcttaaagtggaactgatgagtcacatgataactctatgtttaactcttcaaggaactgccagactgttttccacagaggatgtaccattttatgttcccaccagcaatgtatgaatgttccagattctccacatcctcactaacacttgttattttaggttttttttttttaagattatagctatcatagtacatgtgaagtggcttctcgttgtggttctgatttgcattttcctgaggtctaatgatatcacccatcattttacatgcttattggccatttgtacattttcttttggagaaatgtctgttaaaatctgatgcccagtttttaatcatggtttttgtcttttatggttgattttaggagttctttttgtattttgaatactaggcccttatcagatataaaatttgcaaatattttctcccatgtctgtgggttatcttttcatttcttattagtgccctttgactcaccaaagtttttaactttaatctatttttggatctattattccttttgttgcttgtgcttttggtagcatatctaagaaattgatgctgattaccagatcatgaagatatacatttatgttttcctcaaagagttttgtaattttagttcatatatttaggtcttgttttatttggagcccatttttgtacttgatatgatgtaacagtccatgtatatttttttgcaggtgcatatccagtttttccccattatttgttgaaaagactactctatccccactggatagtttttgtacctttgttgaaaataagacaatttaaaatgtaatggcttatttatggattctcaattctattcctttgatatattgtgtttatccttatgctagtaacacaacatcttgaaattgtagatttgtagtacacgttgaaataaaaaaatgtgagtcctccaattctgccctttttttttaagactgttttggctattctgggtcccttgcatttgtatacaaattttgggattcactgatctatttcaacaaaaattcacctgaagttttctagggattgcattgaatttatagatcaatttgtgaagaattaccagcttggcaacatcgagttttccaatccatgaacacagtatagctttctattttgggggtcttcttttatttccttgaaaaataattttccattttcagtataaaagtttctccattttttggttaaatgaatccctaattatcctattctttttatgctattgtaaatgaaattttattcttaaaaccatagagtgttgtattttgacattatgtcctgaaccttgctgaggtcatttattagctctaataatattttgagggattcttaaggattttctgtgtatgtatgtgtgtatatatatatatatacatgtacatatatgcgtgtatatatatacatatatatgcgtgtatatatatatatacatatatatgcgtgtatatatatatacatatatatgcgtgtatatatatatacatatatatgcgtgtatatatatatatcatcatgtcagtatttcttgcagtcaggttgatggtgatgaactcttcagtttttgtatatccaggaatgccttaatttttccctgacttctgaagaatagacataccaagatatagaatccttggttgataggtttttcttctgccgtttttaatgtgttctctcactaccttctggctttcatgattttaatgaaaaattactgtttagtttattaactgctcatgataagtggcttgtcccttgctttcaaaattttctccttgcctttgtcactaatatttcgatctaggtgtggatctcttagagattttcctacttagtgttctttgagcttcttagatgtagagattaatgtttttaatcaaaataaaaattttcgtcgtcattctatcttcatatattctttctgcgcctttctctttcttctctctcctgagattcccattatgcatatgtttttacactagattgtgttcttcaggtctctgaggctctgttcatttttcttaattattttctttattgttccttagagtgtataatctcaaatgacctgtaattaagttagccgatcctttcttctgtttctgtcttctggtgaacccctgttttgaatttctatttcattggttgtactttacaacttcattacttatctttaattctttctatgttgtaagacattattctcatacattcctttagtcttttgtccagagtttcctttagttatttcagtgtatttataatagctgatgtctttgtctactaatccatcatctgagctcctaaaggatcatctctgttcattgtttcccttcccttctctgtatgggcaatattttttgtttctttgcatgtctcgtaattctttaatgaaattggactttttacataatataatgtggccagtttggaaatcagattctctccccagggtttgtttgcacagtctttgctgttgattacttccttagtaactttcctggactaatttgctaaagtctgtatcgtgtgtcatgtgtagccactaaagacgctgttccattagcttagaggtcagctcatgattggacagaaatgatcttaaatactaaaccaataaatcacctggacttttccaaggggctgcatgtgtatccattgagatacactgtcaacattccactgggaaacttgcaactttatgttgtatttcacctcctgttcacatagagactttaattcagccagaggtgaacaattagggtcatctgaggtctttccttagcatgtacacagccctggggcaaacacacaattctgtgcaggagtgtggtattctaaagtcccacagatgtgacagagattttctttaagcacctggaaatctttcctaccttttccttttttgttttttggtcagcctcttgttagctccaattggcctcaccgtcggaagtagctgtgatggcaaaaaattgccccagaaatagcactgtccacatagagcacactctgagttagacgaggtaaatacatgctatgaaaagggtgcctttttagagagctgacatacaaatgaaatagtgacagttttccggggacagagctttcgaaagcagaaaggaaatcctcccgtgcaggggctgctgggctgctggttttcacagccactgtggagcaaacctggtggctttcaggctaccacacagctgggcacaaagatgggaatggaaaagttatactgccactaaactttctgttcttgctaaagttttcttgtttttcttgatgattcttaatgatgccactccttggattgtgacaaacctttggctgaattccaaaattctggggaaaaaaagttgatattgaaaatatatgtgagtacaggttgagcatctctacccagaaatctgaaatctgaaatgctccaaaatcctaaaagttttgagcaccaacatgaagccaaaagtggaaaactcctctcctgacctcatttgatgggttgcaggcaaaacgcaggctgacagtgatgaagctgatgttcgtaacactgcagaaaaagtgctgatagatgacatggtgaaaaagtgtgatgggcttattgaaggactgaagcagcctgtattcataccaaaacaagaaatcatgtaagtttaaaaatcaacaagaaatttctaagacaaaaaacattgttaatgagagagatgactctggagaaaacatttttaaaagtcatccagcagaatgcctcctcatctctagaggatccacttcctggtccctcaattgcttgtgatgtctcttttcacctacaaaaataaaatacagtgaccaataatcgtttaatcaaaacacagcatcgtagatggagactgaaatcctgctgctgttgcttcttgctgttgtttaacagctggggcaggtattttggtgatgctactgtgctgcttagttaccctgaacacattattttcacagtattaatggtatgtcgtatttttattgttaaatatttatgggtgaataagtgtaataaaatgattgcttattggtagcatataaattcgagtcagatacaatggtgatactaaacaatcacagattgtccacatgggcggctgagatagggacaactttctttctgatgtttcagtgtatacaaactttgtttcatgcaggaaaccggtaaaaatattgcataaaattaccttcagcctatgtgtataaggtatatgtgaaacacagataatgtttacacttgcctctcatccctaagatatctcattatttatatgcaaagattacaaaatgtgaaaatatccaaaatttgaaaaatttctggtcctaagaattttgaataatggattcttaaacttattctccctccttttatgaaggagcagattttactccaccgttgtgaaagtagttccctctgctgtatggtttttgtataggcttgccatcaaataagtgaacttctaatgttctgtcattattttctcatttatcatgaagagataagtgactctttcacacattctatagccaatacgaagataatcataacattttcccctgtactccattaatgagaagtatcccattgatttacttttaaatgttacaccaatcataaattgttgacataaaaccttacttgtgtatgatgtttcatcatttttatatatgaccaaattccctgtgtaaagttttgtttaggatttttgcctttatgtttatagcaaggctggaaaattgttttcctttcatgtaatatccttctcatgtttcggtatcacagaattgcagtgcatatcaaattagtttggaaacagaaaggtcagtgtgtggggttgcaaacaaacatcttgaaaatatgagtgcagacactttaaatatttaaagtacagacactttaaatatgagtgcaggcacttgaaaatatgagtgcaggcatattaaatcagttgggagggattttgtttttgtaaatttggactgaaactcagtgaggacatgccaattcagagttagaagaaaacagcagatttacacagggaaaacactcaacgtgtggaggtagccccaagtttgtgctagaaagaaaggtcggtgttggtaaatagagcagctactccagagagctttccctcatcatctctctgcctcccacatcaggtcccaattcttctgtgtgcattaataaatctacttcttactattgctgaagtcagatatgtttttagctaccaagcaagcaggaggaacatccatttttagaatagtgtagagaggacatgaaggtttatctggcccagattcacattccaaaatgacttcaagttagtcttttgaatccatcaactaatgaagtttttacacagtcatgaagacataaaagcaggaattaaggaaaaaagcattcattataaaacttaaatttcagtcccatggtgcaccatgaattgacaccatcatgaaagcatttgaaactataaaactcactgatagaaccaaaacacaaggaagaaagagaaaggaatcaaaccttattattacagaaaaccacccaaccacaaaaataaacaataagaagggaagtaaagagcaaaggatatacaaaaacaaccaggaaacaatcaatcaaatgataggagtaagtactcacctgtcagtaataaccctgaatataaacagattaaattccccattttaaaaatatagactggctaaaaggattaaaaaacaagacccaactatatagtgaaaactaacctcacctgtaaagacatacatagggtgaaagtaaagagaaggaaaaatattccatgaaaacaaatcaaaagcaagcaggagtagctatatttatatcagacaaaacagacttcaaattagaaactggaaaaaagagacaaggaatagcattatataattataaagggactaatttagtaaaagaatataacaattgtaaatatgtatgcactcaacagtggagcgtccagatatataaagtaaatattattagatattaaggaatatatagaccccaatacaataatagttagggacttcaacaccctactgtcagcattggaaagattattttaacagaaaatcaacaaagaaatatcagatataaactgcatcatagactaagcagacctaacagacatttacagcacatttcaccaaataactgcagaatacgtattccatcagcacaagtaacaatgtcaaaagttagccatagggtacaaaacaagtctcaagaattttaacaaatcaaaatcataccaagtattttatctgaccataatggaataaaactagaaagcaataacaataggaacatttaaaagtatacaaatacatggaaattaaacaacatgcacctgaatgataatgggtgaagaaagaaattaagaatacaatttcaaaattccttgaaataatcaaaaatataaacacaacataccaaaacctatgagacccagcaaaagcagtattaagaggcgagtttatagcaataaatgtctacattaaaaaactagaaaggtttcaaataaacaacctaatgatgcatctcaaggaactggaaaagcacaaacaagccaaacccaaaattagtagaaagaaagaaataataaagatcagagcagaaatacacaagagagagactaaaaattacaaaagatcaacaaaacaaaaagttggatttctgaaaagatacacaaaactggcaaaccataaactagaccacctagggaaaaaaagagagaagactcaaataaaatcagaaatgaaaaagcagacattaccactggtgacacagaaatacaaaggattcttagatactattatgagcaactataagctaacaaattggaaaacctagaggaaactgataaattcttagaaatgtataacctataaagattgaaccagaaaaaaatttagaaaccatgagcagttcaataatgagtaatgagactgaatcagtaataaaaagcttcctaacaacaacaacaaaatcccaggaatggaagacttcactgctgagttctaccaaacttttaaagaagagttaacatcagttcttctttaaactattccaaaaaattaaggaggagaaaggagaaaattctcccaaactcattctatgagtccaacattaccctgataccaaaactaaataagggcacgtggacacacacatgcacacacacaccaaaaaactacaggccaatattccttatgaacatagatacaaaaatcctcaataaaatactagcaaactgaacccaacaagacattaaaaagataatacactataatcaagtaggatttattccagggatgaagaatgtgtttcaacatatataaatcatttatgaatgttttaaataaatgtgatacatcacatcaacagaatgaaggacaaaaagtccatatgattatctcaatagatgcagaaaaatcatttggtaaaattcaatatcccttcatgataaggactctcaataaagtaggtatagaagaaaagtatctcaacccaataaaggccatatagacaaacccacagctaacatcatactgaactggaacaagaaaagcatgccaactctcactgctcttattcaacttaatattagaagtcatagagcaattaggaaagagaaagaaataaaagcctttcaaattggaaaagaagtctaattatccctctttgcagataacataattatatctacagaagaacctttagactctgcaaataaactcttagaaccaatcaatgaattcagtaaatatgcaggatacagcatcaacatacaaaaatcagtagcatttctatacagccctacagggcttagtgggtgttctccctgtgtgcagagacaagagattgtaaaagacacaagaccaagagataaagagaaagcagctgggcccaggggaccactaccatcaagatgcagagactggtagtggtggctgtgtctttagctttgcaagctttttagtttgaggtagtcccacttgtctatttttgctttttttgcctgtcagccctgctttcttttccctgtcacaggtgtcactccccaggacactccccagcaaaccccctgttcacaaacatttgcctctgggactgttttccagaaaacctgacctaaggaagattataaaagtttatcattatccaaaaattggagaagaagagtagaaaaaaaatagtactgtcactttttcagcatgtgttctgtatgtaacccaggagtttatctcatttcaacgctaggtctcctccccctgcaaggtgctacttggggcacactcctagtagcgtatttgcccgagcctaggttcctcagtctggaataacccttgctggaggtgagaaaagtatgtagcagaatggtccagtgaggtttggggcattccaagtctttcaaaataatcgagagtgggcactgacgtaacatggttagtctttttgaggactccatttgctgtgagttgcagataatcttaatttttctgagtgtccagagagtgttggttggattagacaacagacagacctacaacatatcaagtgtgaaaaccaatatatatatcgtaacacatacagaggtgaacacaggaatctgccccaacagttctgtatggctttagatgaaaaccccctggattaaaatagcttaactgttggcaggatctcttatgcataaactcgtctcaggaaagtttttcacctgcagttgacaatcctgccagaggcagtaaaattgaggtttctgattcttcatgttattgtacatccctaatcccattgaaatttaggagataaaatcacttgtcccaaatcacagagtcagcactttcacactcatgatataaattcaagttcccccagtccctaagcctcttcctcccactacgtattcataggaaggaggcctcatatctagatcttccctcacagcttcccaccccactcatacccccaacgaatcacagaagcaggatgtgcaaagagaaataggctcgtttatttattcattgatcaactggcacttcttgaaagcctgctgtgtgccaagcctttccccaaaggaggatatcagtggtggagccaagtctcagggtggaaaggacctggaccacacagagcaggactccagagcctcctccatatggcaggaatcaagctgtgagagaaaatcagataagagcttcagcatagaaaccagccaaatcatatccacatccttcctcctgcccaaggatccttctgagatagagaaaatagcaagatagcgctatagttgagagagacttagtgtcaggagacaagtctcattttcaccgtaaaactctaaactcaaagcattgaactagataatcctcaaactccactgatcctttgtgatttcacctcagaaaacatgatggaaacaacctgaataataaattcttagtgcacatagtgctttgcagagcactttcaatctcattatgtacattttaccgataaagaaactgagactcagaaagacacttgcccaggacccccacccagagacactagaatagaatcaaagccacaggcgatcctatggaaatcctggccctgagacctggagaacagttctcttgaaggacaagggagtcagacagaggctgtgcttggagtagggttcaggagtccccctgcccatatgcctgggcctccagagggttgaggctgagagggctggagggagctcagtgtgccctcatcccctgcttacctttcacaggggaaacgcaggatttcccacacatgcccatgcaacacttcaagtcacgcttgcactggccatccatctcacagaaattgggggggttaagcatcaaacattggccataagtcactgggcacttcccaggcttcctccttgctgggtgagagtgaggctaccggtcagaggccttgtactttatacaacccctcccatccccactttttagagtgagcccctgctccagcttcagcaggggggatcatcccctccccacctctatcaccaccaccttctccctaaggcggcccccaaacatagcacctggctctcctagaacttcaggccccccattgatgcaggtggccagccacccagtgctgactaggtgggaggcttccaactacctggctatctaaatgcccgctgcttcaccagctgctggctaccttcctgcttagggcagtgtgactcactgacggattgacaaggaggcctggcaggacccatcacccagttccatccctctaatgctgtgtccccaggctcactcctctctacccagttccccgacctgcttacttgggtttggggtgtcaacaggatccaggcatttgatgccacaagtgtcaggacaacatctcttcttccctggacactgccagtcactctggcactcaggtttcttgtatctaaggcactgggcagatttcttaggaggacagactccagctttgaaggcttttgaagagaaagtcaagaggtcaggaggaggctgggtactgaggacccatcatgcctcctgaacaaagcaccacttttgagggggagagacccttacctcagtagctgtccacaaagcccaaagggtcatgcctgcctgatctccaggtgtattgatgggcttgattaaattagacaaatggacaggggacgtttcacacccaagaaaagggcagcaggcttctagtcaagacctcccacccaagagcaaaacaaggctacacaaaggcagagaggaaggctgggagtgatggagatggagagaggtaaacaaagataaatagaaccagtgtgagagaagttgagagctaaagcccaaggcagaagcacagagacaaaatagcagaagcaaagacacaaggaagcagagtcagaaactaatgatttgagagtcgcagacaggtgaagaagaaggcggagtatgagagagagagagagagagagagagagagagagagagtgggacctgggctgacagcatggctgcatagaggaagcatttccagaagctcaaactgtcacacaaaccttggagctcagccagacatgtattccaccctcagggaggtctcccgaaactaagctgagggatcagagcctacagaaggggacacacccacaccacaaggagaccccacctctgaccctgcagcccagattagaccagagtgactccaacttacactttccagagccttccacagcccaaggtgccagagttcccagggcaagcagcaccaggaaggggaagaggccgctggacttcatggtgaaggcaggagtgactctgatggccaatgccaaacctcactatttattctttcaccagtgggtgtggccccaccagaattctttcggcctctcccagctactattgcataagcaggaaacgtagccagagaccagaaatcctgacaccaaggagattgtttatctttcctatgccaggtaaggctatgaggccaacacagcaactatcagaaaagaaagggaagagattggcctgggaagttggttgattaaagaggccatctcagtgtccatctgagccctaaacatcacaagatcccaggccattagccttataggtggagagagggaagaagtggtcaattgcaaaggtgctacccggacctggaactaaaaccagacacagactccctgctgagactttgtgcaatacattctattctcacattgctaattctgattctcacattactggactctcaggcattgtgaaactctgctgattactcaatgcagtttctttctcaaaagttcagctcgttcaaccaactgatacttagttccctgaaatatttacaccgttatatccccagtgcctgttctgtgcctgacacaggaaaagcactcacaaatgaaagctgaagaagagctccgctctccacaaatctctctggagctcagttgtctcagctgtgaaatgaaatgatactaacaagtcagcccttctcagagggttatgaaattaagggcatgaagggactctgaatgaaaagaacaaatgaatagtatcccttcccactaaagagaattgaaatgaatctgagataaagggggaaagcagctcatcagtcactgtaatctacatttagctgtgagataatttgagatcttagaggattgcttcctaaaattccccaaaatcccttacagatctcacatgacagcaaaaaattaaacccattctatttgctacccagtctgcataggttgcttctaattataaagagagcgaccattatctctaaaattcagcccatagctgagtgtagggtcgcacacttgctgtctcagctgcccaggaggctgaggtgtatggattccttgagagtaggagtttgagaccagccctggccacatattgagaccccatctctacaaaaaaatgtaaaaaattagccaggcatgatgacgtacgtatgcctgtagtcccagctacttgggaggctgagccaggaggatcgctttagcccaggagtttgaggctgcagtgagccatgattgtgccactgcattccagcttgggggacagagcgataccctgtcttaaaaaaataaaataaaataaaattcaaccaaagctcatctagctacaaactccaagctcttgactcattatcttcatgcttggaattctcccattcattcctaaggtgaaggtttgtggaactttccacagacatgaaagacccactcattatcaagtagcgatggccccacatgaagtatttaagtattccacaaccaaacaggcaactggcagcagatccctttatacaaaagtcactccatggtttgaattttggtggatcagaagacttggacataatcaatcatcagtcaaattttggtggaaaaagaaaaggaagaaaattaatatgcacaaggtaactactatgagccaggtgcattcactcttagttggagtacttagtagggtaggtaagagagaaatggaggctatgatttccaccaatgggtaatgacactctcaggtcaagatttttgttctcacttccaccacccaggggataatttgatttctctcacagagttcctgttctctctctctctctctctctctgtttgttcctattttcctcagtgccacactcaagaaattatctggagttttctaaatatttatttcttaaagaatgaaaaggggctgggcacggtggcttatgcctgtaatcctagcactttgggaaaccaaggtgggcggatcacttgaggtcaggagttcaagagcagcctggccaacatggtgaaaccctatctccactaaaaatacaaaaattagccaggcagtgtggcacacacctgtaatcccagctactcaggaggctgaggcaggagaatcacttgaaccctggaggtagaggttgcagtgagctgagattgtaccattgcattctagcctaggcaacaaactgagactccgtctcaaaaaaaaaaaaaattaaaaggaaaatgctacagcttaagttttttttaaatctgtgattgactgattgctcaatctgtgattgactgattagagccagctcctttctcatcagaaaagagccctgtgcccaattagcaatgtcttccatgggtgtcataagaagataatagtatataatcattattatctttgacataattggttctaaatgtttacatcatagaatgttaagactaaaaagaggacttcaagggttttctagatcagcaaactacagtccttggaccaaatccacctagttacctgttttcataaagttttattggcacatagccacacatccattaatttatgtattgtctaaggctatctttccactacaatggcaacagggacctaaaatatttactgcacagcctaaaatacttatcgtctggtcctttacagaaaatgctaacccctagaccaaacccacagcttgcataaaagagactgaatcccttagaagaagatccaggcccaaagctgcatagcggattaacgacacacacaagattgagcttttctaaaacaggttactcacatgctgatccccagaacctgtctggtggaggacacttccactcctaaccaaatcttaacctgagactgactcattcaatctatctcaaggctgggagtggtggctcactcctgtgatcccagaactttgggagactgaggtgggtggatcacttgaggtcaggagtttgagaccagcctggccaacatggtgaaatcccatctctactaaaaatacaaaaatcagccgggcatggtggtgtgtgcctgtaatactcaggaggctgaagcaggagaatcacttcaacctgggaggcagagttgcagttagctgaggtcatgccactgggctacaagagtgacactctgtctcaaaaaaaaaaatctatttcacacaccctttattgccttctacctaaatcctatagattccttcattcatttatacaaaccattcacacaaaagttgtttaacatttcttaccacatgtcaggtattgcactaggcctagggctacagaaaagagcacgcccacggagtcgacaccacatggttgttaagaacctgaacttcaaagtcagacttacaggttggaagcaaatcactgaacctctttgaacttcagctacctccactgaaaaatgagagtgttgctgcctctggagtcgtacagttgttgtgaggagtatttggaaagcactcagcaaactgtctggtcccctcagtacattacacattgtttttattaccggcgtgtccctgcacacattaagcgcacagggagctgtcagtctttaactaaatagcttagtccttgggtctggacccatctggctctgtcccattaaatgtttgacaaaacatggtcttatttcttgacaaaatagacctgattgggcctattggtaggtaggtagacagacagatagacagatcttaactgacagatagatatagatagatagatagatatagatagatagatagatagatagatagatagatagccagataatcaactattggttctgtttctctggaaaaccctggctgatggaacctgcttgcctctgcacttcccaatgccatttattaaagttggttacatcattacttgtgaggctgcatcatcctttatgccttctctgaatactggcttccaattactgtctcaaatgttgttagtgtggccgcttgtccctgactaccagggtgctggtgacagggggaccctggcagctggtgggtcctgcacacaccaagtagcgggacagggaccctgcgcacctctgggagtctgcactctccctgtgagtatccacatacttgtggaggagcaacagtaaataatttttttaacaccatggcagatctagagagaaactgccaaagaaagttaaaaaattaattttagtaccgttaacactttttttcctgcttttgaacaagcagctccacattttcactttgcattgagtcttgtaaattatgtagccagccctggaggggctcagggttgaagtgagaggagcatctcatttgcacaagaaatgtctctgcctaatccattatggctcaacactgacccgagagagcataggtcaatcagaggaaaaaaaaaaagacatcaactgaaaagcccctttggagttgcacagagatggcctggaaagccctgaggaagagacaggagcagccacaggctcctgccaggagccatccaaggtggtaggatgactgccctagattctagcaatgggggaaggagtacagagtgagaagcacccccttggactagaacccatgcagttctcagtccaagctgggattctctgccccatggcaccattgatcctggctggcttcaggcactccaggggaacatagacaattttgaggaagacgccccaaggcacagagcgacctgaagtgtgaggtgcagggaaggagccccgttgctcaggtctaaggaagaatgtgtttcgggtcgccccattctgatagcagatgccagcttcacccttaactaaaagtcactgtgttcttacctaaaattcactatgtttccaagtctcaaaaccaaaaaacaacacagaacaaaaaactctttcagaatctggcagacaaccaggttttcacagctcattcctgtgtgaataaggcagcaactacctttccctgggcctcagttcctctacctgtcccaagacggtaactgtgactctaagaaacagcttcatcctgcttcctctgaggccatcagctctccccaagagcctcagccaattttctgactttcatagttgcctttataacttagcttaaaatattgtcttaaacaaaatacataaaacgtcaataatgaccaaatgggaatggagacacagagccagggagtatggagatgtagtaggtgtggtggggagagtattggggaaaaaaaaaccccgagctgagacaggaagagtagatgagaaagagatgactgcaagggaggtggggtcatttaaatcacctctggaagtgtcatccacaggtggtggacatggcaactggatctccctagaccttccagagaaacagatggcttagccactccttatcattttcccacccaagaaagtttgaattctgcaatgtttgtacttcctcccctactgctcatcatagtcctaataaaatctggaaatatgaactgtccttttaggcccacaagtgaatgggtgaagggcagtaaagcagaatctgggcaagggtgaaaaacatccaccatcaaagaattggcaggagaaattaaccaacaacggtggatctcaggtgtcttcatacttattaccatgcaagagatggttggtgtacagatcagggctctgcactttattccttcaaaaactgcatgtctgtctccctagaggaagggatccagttaacctaaggttaaagaaacaaagtctgtggtatgtcatgaggaaatgctttagggacctggtaaaacaaaaagaaaaacagtgctcggcattaagaaactgccatcatgactacccatggaagaaaaccgggaatagaaaaactggattattaaactgtggaacagagctataagcagcttgggaaaagatgtccccaaatcactagaatccatctcctttggtttagcatgttttgttacatttaagcgtcacacaaaacttggtagatactaatgtcaagtcagtttacagatgagaaaaagtgagtctcagagaaacgttcctgttgcagatcaggagatggtagggtcttagatggacatggcagacgatgcctggttgatcattactatgggagagtttggtgtctaagcctggggtcagtggagagcaccactatgaggacacctctgtggcccaaacagagcagagtgccagaaagaccatgaaagactcacacttgatagcatcacttctggcctctgggaccctgtggtcagctagagaggcatgacgatgatactggactcaggacactgggctggaatcccagctctgtccaatttgatgtagaaccttcctttctctgggcctcagtttccctatttgtaagatcagtgcattggaacagatgctctttagaggccccaagtcttagattctagctgggtttttgccttatagaggactctcaggacccagagagccaactttcctgaataaaaagcctaggaatagacaccatgcatgaccccgaacttcacagtggaccaagcacttttatatcccattttaaagaaaaggaaatggaacctcagagagtaagcccacttgcccaagatgacacagcaagtcagaggtacagtaagattcaaacccaagtcttcagaattcagccacatactgcttcattatggtccctccaagacttctttagtcctaaacccagagttggagatgcctgggatagtagcactgtccagataatccttcggcggaaagttaaaaaatgatcttaaagatgcaagaagtgagagtgctgaataaaccaaggagaataggtgctattttcaggtgcaatttgagcaagggctcaaactatagctcccacaagattctctccacggcacttctcttcatgttggcttcattcttagtcaggctccctcttagcatttataatatggctgtggcatctcctcccatcttcccaaattcatgtctagtaagggctttttctgggcaactcaactaactaggagtggctagaattaaatctttaaaccaatgattgggaccagggaactgggatgtaccgattggtttaagccaaggccacaatactcatcaccatgtgtactcatccccaaatccagtggaattttcagagtgggagagggaatgattctcctggggtaaattaggatatagctaccagcagaagggtgaaaggatgctcagtggtaaaaatagcagtgagtgttctctaaagtataccccttttggttactgaaatctacataactaaattttttcaaatactttctaaaccaacatctacataaaatgcactcaacctctctcccaaagaaagacaacaaaatgtctctctgggtactatattcatctccagttctgcaatgtgggtgaaagcagttctgtcagttaaatttatagtcttcacagattaagtttaataagcttaagtaaatttaaccacttcaaatgcacccaatatagaatggtagattgagggcggaatgactgcaataaaaagtcctatttgcaaaagggaaatataggaagatatatacaaattgtcactggcccgtaatacggattgtacatcctgtaagacagggatgtgaggacttcctacctaatgttggagtgatttccttactcaataaatctgaagaatccagttctgctgtctgggagcctctcctttgcctgtcaccttccatggctacatcttggaggagtattgcagaggatgcccttttgttggggaaggaagggcatctgcaccttttcaagaattcactttatataggtgcagcaggatgtggggatcgacatgaacaatcagtggccattatgaggcttggttttcatgtttagttggctcctggtccatttgcttcatataaaagcatgaactagtaactattgtcagaaatctcgccgagtcatgtttgccttttatttattctgctttactccaaatatgcacttttagtctgaagatgcatgtcttaatttaatcctaaaagaaaaagtcctttctttatctctttgaatattacttctgtgccattctctccagtctctttctggaacttccaccggatatttactagaccttctatttttattatcgttgttttgcctttctcttatatttttctcttcatctctctgtgctgggctctgggtgaatttctcagtactggctaaaaattcaccaagttttctttcagctgcatccagtctaaactctactttatccaatgtttttccaacttttattttaggttcaagggtacatgtgcagcttgttaacatgggtaaattgcatgttaatatttgatgtacagataactttgtcacccaggtaatacccaataggtactctttcagtcctaaccctcctcgaacccttcactctcaagtaagccccaatgcctattgttctcttctttgtgtccacgtgtattcagtgtttagctcacacttataagtgagatgatgtgatactctgtttttggtttttctgttgctgctttaattcacttaggataatggcctccggctccatccatgttgctacaaaggacattatttcattctttcttatgcctgcatagtattccatggtgtttatgtatcacagtttctttatccagtccaccattgatgggcatctagattaattccatgtctttgctattttgaatactgctgcaatgaatatatgcacgcatgtgtcttcatggtagaacaatttctattcgtttgggtatatatccagtaatgagattgctgggtcgaatgctagttctatctagtaagtaatgaatttttatttcaataatcatttatttccagtatttctacttggttttttttatatgttcatctggtaaatctaaataatgtacagttgtctgccacttttttaccaaattaggcaggacaacccttaggccaattgttaggtatctgcattctctgaaaattcagcctcattgcttgttttaaaagacatagaaagagacttagcatcaataaacaataagcacctaaccatagctctcttgtttgatgttgtttttcctcccatgaacataaatcaaattatcaatcagcaatgcctctatgtgcatttatgtttaaggtcttcctcaattagacagctaaccaaggtcatcccctacaaaataagacatacaagttataaattggtgcatgctggaaaggaattagcatgatttgcaaacctagagtgtgccttaagattttcccatagaaaatggaggcaattatatctctattctggtgtctgtaatcctagcactttgggaggccaaggtgggaggatcgtttgagcccagtatttcaagaccagcctgggcaaaatagcgagaccccatctctaaagaaaaataaaagaaaaaaataaaaatttaaaagaaaaaaaatcacttgtggagacagggaaggagaagctgagaaaggaataaaaacatgggaggggcagcatgtccagtcatccctgttggtctaagagcagcaatgcacttcaagggagaggctgggtgtccacctccttcttttaccagaaggcttgaattcccttggctcgaattttgccatttgtgcaggttggattcttcttagcaattctggagagactgagaaaggtggttgccctcagaaaaaaacagtacaaagaagagttagagaactcatggatggggagagctgggatctggggcaacagcagcaaatgtctgaaccagaagtagaagccaagaaaattcagtggtggcaggagcattcgaaacctcccctcccaagaaatgatttgtgacagtgtcggattgaagaccaagatgtttctcacatttttcccccacgggctggcatatctccccaaagggagacatccatttactcaaggaccaacaaaaaagaagccatgacttgtcactaaggaagttgtgggccttgataagacatattaaaaaaagaacatggcctctgtggcggttgaacatgtgtttgctttgtaattgttcattaaatcttactcttattttatgtgcttttcctaatgcatgttttgttttacaattttaaagtgttgggagaaagaatgagtattggaaattaggcaattgtcagcaatgctggaacctacaggggaggccaagaggagaaagaaaaatgacctatcaaactctagaacaaggaggatgcagacccccaattccacagcctggactaacatctcccaaattatcctatatcctttcgcttgatctcagtgacattcattaaaagatcacagactttggaatcagactgaccagcttttaaatcctgtctttcccacttaataaatatgttccctttgataattctgatacttgtggctaataattactgagcatcttttttatgctggacactgtgctaaaggctttgcatgctttttcacatttaaacctataacaatgaataaagcaggtagtacagtatccaattttacaaacaggaaaaataaggctcagagtcggcctcctatacaaggtgacaggaggaaggaatgctttgggtgaatttgataggggctgtctaaggaataatgcttcttacccaggcctgaagagcagccatgattccctgtgcccaaagctggggtaaggagagagaaccactgagggtcaactcttcagttcatgcaactgatgtgcctgctgtacagatggtgcgtgagctccagatagaagcatcagttagcataaactgtctctggtgtcatcttgattaaaaataggacaatctccaattttataaacacatttttaaagttgtattttccacatttaagtcgttaatccatctggaatttatttttgtgaaaggtttaagtagagactttgtttgattttttttccaatatggaatgccaattgttccctatatcattgatcccccttttgatcataaaactgtattaattttgtaccagttttcatatgtggatggatgcactctactaggttttcttactcaatttgttcactcccagaccaataccatactcctttaatttgcatctatattttttataacctggtgcttcgcagtagaagtcttttctgttttgcttgtttagaattgttttggctatccctgtgcttttactctaccatgtaaactttagggtcaatttgacaaggtccttaaaaactctgttgaatttttattatgattgcatccatgctataaattacctggaagagccaaaatatttaccatagtaagtcttcccaagtataaaaaaataagtctcactctatttattcaaggcctcttcaagtcttttaataaaattttattttcatcatataatttttccaggtaatcataaattttatggctgttgtgaatagtttacccattgattctcttggatttcatcctgagacaatcatatcatttgtaaacactcacaattttatctctccctttccaatccttatacctctttatttttatgtccaattttattgcattggcctaagatcactaatatgagattgactgaaaatggagatgggagaaattctgcccttgtacctgtctttaaggatgccatttctaaagtgtcatcactgagtatatttgctgcgactgttggtaaataccttttaccagattagttatgttcacttttgttcctggtctagggtgtttctatttttattacacatgaatgtagaatacaatatagaatgatttttatgaaactatttagagactcatttgggtcatctttaaacttttaatttgcttaatccccttgatagattttctgttcttgaactatctttgcatatctgtttatttatttatttattatatttattatagggataccctactattataataaatgtcctagcatgtattatacttgtcactttgaaatatttcaaatgtatggaaaaaaatgggaagaacagtacaaagaactaccatattcccttcacccagattcactaaatattaacattttgccacatttgttttatcattctttctcttttgtgtgtgtgagagaatagaatgttttattccaaccattgagaataagttgtatacattatgctcctctgtccatgaatacttcagtgtgtattcgctatgaataaggacacctttatataaccacagtacagttatcaacttcaaaaaattcaacactgacaaaaaatcccaacattttggattttcccatgtattctcataagaaaaaagagtctagtttcttaaactctgattatgatataaacacacaatatcaaagataagcaccacaaaagtttccatccgtgctttcccttcttttagtctctgaaatcatttgggatagaaattgtctttcttgtaggtttggtaaaaaatgaatacatttcatattatttcccattttaaaagaagagatttaattaccaagtgaaaacctcttaacttgttttcttttataaaaggagaaatttaattaccattttaaattctttaatgattagaggtttgttcaggtttcaaatttcttcctggaaccagaaaggacaaagagaggagaggaaactggtcatgcctggtaaccactgaagcaattcatttcagacctgtgttacaactcctgataaatgaaatcaaagaggatcacactcatgtgtgtgtgatttctgaatagtgccccaaagaaagtgctaaacctgaccaacaacagcaacattctcaataggaggtggagtgaggattggtgccacaaggaacctggagctgatcctaaaggaaaataaatatctactagttgttgaccgatgtcactgtgcacttctctcacaaacaatgcctttattcctcaccaccatacaaaaaaggaattaatattaaccccatacatacatggtaaaattgacgctcagaaggatgaattcccgagcaatttggacataactcacacaattatgatttaagatatgatctgtctcactcaaaatccactattctttccactccacatgctgagagcaaggccacaaatcccaccacctctctcacttctctcctttcctcccatcatcccccatgtcctagaccatgggccaggtacagtggctcatgcctgtaatcccaatgctttgggagaccgaggcgggagaatcacttgaggctaggagtaacataggctggtcttgaaccagcctatgagacctcatctcaaaaagaaaaaaagaaaaagaaagaaaggatggaaggaaagaaggaaggaagggagggagggagggaaagaaagaaagagaaaaaagaaagaaagaaagaaagagaaaaagaaagaaagagaaagaaagaaagaaagaaagaaagaaagaaagaaagaaagaaagaaagaaagaaagagagaaagaaagaaagaaagaaagagagaaagaaagggaaaggaaaggaaaggaaaggaaaggaaaggaaaggaaaggaaaggaaaggaaaggaaaggaaaggaaaggaaaggaaagtcaggtgtgattatatgcacctgtagtcctagctacttgagaggctgaggcaggagacccccttcaaccgaggagttcaaggttacagggagctatgactgcaccattgcacttcagcatgggcaacagagtaagactctgtctcttaaaagtaaacagataaataaataaatatattgagtctaacagggtgggaaaacacttagataatctctagagagactctgactatactagtctaggcttgactcgtcagccatctcatgcccattcccaacccacccagagatcccgcaaacctgggagatcctaacaaaccattttttaaatgaagagaagagactatggcagaatctacagactgatgcaatccacatccatttcaaccattttttatgtatctctctatagtgcagaggctacaatgttaaaagctacattctccagaccccctgaaggtagggtcggctgtcatttatgtttcaccagtcagatgcactctcacaagggttgaaccaaggctaagttagaggaaagcagagtgtaggacatatattctgctggtacagaccatggcagaagcagaatggttctccagccgggagcttcctgaattgtagccaaggcaccatgactcagggggaggaaattttcctgatactcagtgtaccggcttctccttcagccctccaagtgattttgtaggacatctaatcctaataataaactttctgtttaaactagctagagtagttcctggttttgtaactgatgcttaaccaatatagaagataagagagatacaggagtttgcctgaggtcaatcagctagttgatgccagagctgaggttcgaactcaagaatcttaggatgtggccttctgctcccaacctcaagtaacctgaactcttgggacaccaatcagtggggctggggtaaaaggaattcttagggagatcctgtgttccccggttttagctgactcctcttcaccccattggtgaaggaggaatttctgacctagggttataaggatggccaaccacatgacacccattgctgaacagatgagatccatagctgtttatttttcacatcccagcctggggacaaggacactgcatgccacccagggccacagggagattgcacttgggagccccgtgtgccaccgggggctgtgagaggcaaggtttatagtgttatgagggtgagatgttctctgcctcccacaggagggtatgactggcttgcttgaataattctgcaggctgtcaggaaactgaaacccattcatcaggagtaagcaggacctgtagctggtcccttaataaagaggttgtttagctatgagacttttaccatgggaatacagtaaagagggaaacttgagattagtaaattccaggtccctcgtgattttatcagatgtcacggtagcagataagattgaatttgaattttaaattttggaccacatctccttgaacaaaattgttgagatgatgggaaaaaaaacagtgttgaagatagcagtgccaggcagctactccctcaaagggataaataagcaggtgacctcttattaatggcccagggcaccagcagttgtggtcataagtgagttacatgaagtcagcctctcctggatttttcacgatgtgaatacatgcttttccatacatgcccttacagtactagaattcatcttagcactggcctttcttctcacagttgtttgggggtttgggcatcacatactggcctctggtacttccagaccttcggcataacaagagagagcaagaccatatgtcatccctgtccctaggattctgccccaccacttccagtggatgcaatcaagcctgagaattgccttcaggaacaagcaaccaccctgttggccagtgttgaactttccctggcaatacaacccgtaatgttagtcagcttctggtctatttgcttccatggacttgtaaccaaagccaagtatcttgttgtatagatgttaattaattcattatgctccatatttcatgtatgcttttgaggtgatcgctcacatttttaattctaaaaaaatttttggctgggcactgtggctcatgcctgtaatcccagccctctgggaggccaagatgagtggattgcttgagtccaggagttcaagactagcctgggtgacatagtaaaatcccgtgtctacaaaagatacaaaaagtagccgagcgtggtagtgtgcacctgtagtcccagctactccagaggctgaggtgagagggtcacctgagcccaggaggtggaggtcacagtgagccaagattgtgccgctgcactccagcctgggtgacagagtgagaccccacctcaaaaatacaaatacaaataaaaatttttatctcctattacttctctaaatatcctcctctctcttttccctcattctaaaacttgaattgggtgcgtttacacactcttattttttccatatccatctgttcttgattcatatctacctggttttatttcctaatgtcttttatggatgttaagaaaacatgggtggatggatgtttatggaacctcttctctttttatggatcttattccttttatccccctaaaagtcttaaaattcttatttcaaggtgattttggggattaggctgttacttacattttgtctcgagtgacaattgttaagtttgttgctgtttcaagaggtccctaatcaaaatgccttttataatcctggaacctcccaacactaacaactatttttctcagtattggtttaaaagtgaaattaaattgagtatcacaattaagcaagttataccaagattggtgtacatttctcagaaacaaaatttatgtgttgcaacaaacaggacatgaagtgattacaaagtacctgtgagaagtttctctctatggaaacattgtgccagctggctgttttgtttagtttcaaagcacggtaggacgtgcctatggaacctgcctcaagggaagcagtggaattaacataggttttactacagccaatcatttgtgcatcaagagagatcgggaaagacaaaagaacacttcctttcttaaaaataaaattatagctgggtggggtggctcatgcctgtaatcccagcactttgggaggctaaggcaggcagattgcttgagtccaggagttcaagatcatcctggcaaaaccactgcactttgggcaacagagcaagactctgtctcaaaataaataaataaagttatgataaaaaccttctatgctccttcccaccattactatcctactattactaggactggaatcaatgtggtgatggctgaatagtgttttggaaacagactttagggcaacagaaaaaccatttgattggtttctaggtatcttggttttctaaaacttcagccttgtggcttgtattaaattaaccaaaattagctctaactcaggaaaaggttatcccttggttttgtcaactgtctgaaatagcttgctttcccagcattatttttatgcatatactttcctatttttgttggcagacttacctaatggaaggtttttgtttcccttctctgtgcccagtcttcctggtccacctacaattttgtggtcacctccgtctagtccccaagtaccctctgggtcagaatcaggttttatattagtagctcagagccatcctgacctggttcttggttctaaatcccaaaaccatagtgtgttagcactggaaggcgtctcgaagatcatctaggccaaatcaaccatttctcagcagaagaaaactgagacttgagaggaggagccctgctcaagtcacctgccaggtagagttacccccatgggcactccctggggcctgttccctgctgccacatgcctcttgactcaatctggcttctcgaatccaactgagccttctccagccagcatccaatacttcttcctaactcttgtttactcattcaatccctcacaaatgcctactgggaatacaaatgtgaataagaaacacatagacacaattacgactaagaggtaaactgtgggattagcatgacctgagttcaaagactagctcgacaatttgtttcctgtgtgatcttgggcaagtgaagagacttctgctgttttcattaacctatgtgaagcagacttattcatgcattcctagggttactgggacaagtaaatggcagaacaatcatcaagcacccagctcagtgtctggcttgcagtaagtctaaaagagtggttattattattatcattacaatgtccttcctgccaggttggatctcagaggggatgtcagtctcttctgtcacttcagacactcatctctggggagatctagttcagactagttgaccactagcccaacctggttctgtctcctctgtctaagactgcagttccctctccactgccttagctttgctatctttagctttggctggagtccctctactctgtgcaccattctctctgaatggaagctcagagacaagaattcttgggaacttgtttctgattcaatgcataatcttgaatggcttgggaggggtaaggtattgcccttcccaagccttaattttcccatctgtataaagagtgtgctgggttgtgttaagtcaaggtgaagacccctcctagcactgacactcctgggcctccaggaaatgccatgctttctccatccccccagccccagtagaggtgaacccttagccagctcccacctccaagcaggtttctttgggaagggcaggggtttctttcttagatggggccattctggctgtcccgattccactctgaggccttatttctctgtcagggcttctttatctgaggtccttagatcccttctgggatccataaatcccaggaaatgatatgccactgtcatgtgcatttttcagaggtgtgagttcatcagcttctcaaaatggcttagatcccaaaaagattaagacccattgctggaagtctagttcatgcctctatcacttaaattctgatttccttgtctgttggatgctcctctgatgttccccaaccttctccttttttctacattacatctacctgttaatctgtatcttcctgcactggactgagagccctttgagagtagggactgtatcaatctttttcacctctgtattcatagcaaaataacacatacccagtactcaataactagggatgctagctctatgaatgtaggaacctttgtgtttggttcatatctttgtcttagatgcaaggcataggacctgacacatagtcagtgctcaataaacatcagatgcagaaaataacttgtggaatgaacaagtgaatgcattcagaaagaagccacttcactctccaactttgcccatccctggggcccctaaaccgtgtctggacatttatggttttctttgttcttaattagaaaaggtcctttaaaaatgcgaacttataccaagctgggataaaggcactggcatatcacccccagtctggggtcaggcaactgggttggtggccagatgccctcatggtagtgttggccacagtgaaaaaaaaactctgctaagctggatgacaaagaaaaagattgggaaattaggaaaaataaggaaagatcagatcattcaaatcctccctgataatcaatgggtgacagatgacagatgggactgcaacatctcctacacagatgacaactgtgtggtccaaccattccccagctggggttttcccacctaaaccattcctgacttgtacttgttaaatgtccccccgcccccaatgatttcccagaataaaattctatgtaggctggtaagagggtgcttctcctcagtgatgaaatccctacagaggggagcttgaggtctcagggaagatgagacctggaatctgaggcaaaggcagaaaaggtttgtgttaaaagatagggaaatagactgataatgggagagcttgaatgacttccaccaacagtcaccccagaaatgatttttatcagagacataccggggcatttctggcaatctctcaagggcttagaggaaggcatcccatttatcaaattgctaatgaaggaagctgcaatctgtcatgaggaattgaagtttggagctctgacaagaccttgaaaaaaagaacattggagattaagtgtctgtcaaccagagctgaacactatccacaagagaggcctgggaccagagggggattctctaaactattaaaccttaaagcatgaatcatttttagttctatcatacatataatttacatttaataaaatgcacaggtttcaaatgtactagttgatgtgttttaataaatgtatacacacatgtaaccactgccccagcaagatacagaatatttccatcactccggaatattttctttgtgttcctttataatcaactttgctacccgctagggaataaatccctgccctaggcagccactgatctgctttctttcactattgattagttttgcgtgttctagaatgtcagatatatggaattatattgtatgtaatcttttgtctagtttttttggttaaacataatgtttttgagattcatccacgttgttgcctgtgttgacaacctgttcctttttattgctaagtaatattccattatatgaatatccacaatctttttatccattcttctattgacaggcatttggattttttctagtttggggctattatgaatagagcatttttaaatattcttttcaaatctttatatggacatatgctttcatttttcttgagtaaatgcctaggagtaaaattgcaagtcatagggtagatgtatatttaacttcatcataaactaccaaaattttccaaagtggttgtaccattttgaatttccagcagcaatgcatatgaattctagttgcttcacatcctcaccatcacttaatattgtcagtccattttgtcttagccactttagtggatacaaagtaatatctcattgtggattacatttgcattttctggtaattaacaatgttaagcatcttttcatgtgccgataatgaccattcatgtatcttcttttgtgaaatagctatttaagtctttggcccttttttgttttttgtcttcgtgtgactgagtcataggtgctctttatatatctatattctgttaatatacacatatcctttgcacaatgtaatcatccgttgtcaggtacatgtattgtgaatattttctccaagtcctagtgactgactttcatttgcttaatagttttttttttgaagtgcagaagttttaaatctaaaaatcaatggcagcctgaaaaaataacagctcctgaggccatccaactggctgtctgccccaggtacaaaaagaagataagactctgtcgtcagagtgagctgaggtccaattccacatgctatctctcatttaactctcacagtaaattttatgaattagttagttttatggtctcgttatacaaataagaaaactgaggtgtagggatgtgttcctatgtcacagtctaagagatatttcagacttgaggaaaaagtaagagtttctgtggccacttccatggtcaaaggagaggactgctggaagaggcgctgcctgtagccttcctgaagcaaatcatggagagccacactcgacagtggcgttgtgtgtcaaagaacaatggtagacagtactgacaatcaagggctaaggaaaaggctattgctctgatttgaagggtcctaataaaccttgagattcttgtaggagccaatggaaatgggagagaggctcaatgatgtaaatgacttatataccataccagtaggtggggtggggtaagacaagatttaatttaacttaatttagaaaaaaatcaaacaaaacatttcttacatccaaatattctagaaaaaaaaatctgttcctcacaggcattttccaatgctcttatgaacccttcctaaacatcactttcttatccacatgacattccatccagtaaaaatgtccaccacagtgtacttagccagtcccctactgcctgttcatgttatttctagtttttgctattataaaagccctaacgtaaatatcactcatcatgcacaaaactttttcctatattttatgtatttccattggtccatatttcttggggcagatgttcagaagtaaaactatgatgtcagtgaacaccaatatttataaattccttggtgttgattgcaagactattttccaggaaaactgtactaatttgcagtcccatctgcatgtctgaaagagactcagcaacattttcagtgactaactgggttttccatgtaccataatagagggaaggacaggggacaggctccagaccgcatacttgagtgttaagaacagtggccaggtagatactccatggaataaattattaggttatgttccagactctctccaggagtggcaagaactctgggcttgatttcagctgaccttgattctcggccctgctttgtcacttgctagttatgtgttcctcagcaagtcactgcttcctctttcaacctccctttaagttatctgcaaaacggagacaataatgcctctatctggagagggtcgtgaagatcaaatgatgccgtgtatgttcccactgtgttataaaccacaagctcctgtgtaggcttgagtcttctctgtatttggttgatgcactccattcctagaacatcagcatctctgatgaagctgctaagatcaagtttgggaataagaaaagttgaagactcgatcctagacccggccaggcgcagtggttcatgcctgtaatcccagcactttgggaggccgaggagggcagatcacctgaggtcgggagatggagaccagcctgaccaacgtgaagaaaccccgtctctactgaaaatacaagaattagctgggcgtgcaggcgcatgcctgtaatcccagctactcgggaggctgaggcgggagaatcacttgaactcgggaggcggaggttgtggtgagtcaagatcacgccattgcactccagcctgggcaacaagagcgaaactccatctcaaaaaaaaaaaaaaaaaaaattcctagactcaggagttccatcaaaaaagcccaaaattttctgcccttagcacaaacacgtcaaaagcctgaattcaatttttccccttcccaccttccggtctttttttttttttttttttttttttttaggtgtagagagctctgagaactgcctaccctgtactccactcaggatgccccccacagggtgggtgtttccatgttagtgcctttccccttttcaaataggggaatgagacaagactcactgctggactttccatttttcctaacactgccccccttaaccttgctaagacccaggtcaaaggtttaaagttatttctttcaatggcacttcacctctatgatcttccttctaaaacccataaccccagtctaaccataagaaaatattagacaatggcagggcgcagtggctcacacctgtaatcccagcactttgggaggtcgaggcaggtgggtcacctgaggtcaggagttgagacctgcctggccaacatggtgagaccctgtctctactaaaaacacaaaaaaattagctggccatggtggctcacacctgtaatcccagctactcaagaggctgaagcaaaagaatcacttgaacccgggaggcggaggttgcagtgagctgagatcatgccactgcactccagcctgggtgacagagcaggactctgcctcaaaaaaaaaaagaaagaaagaaaatattagacaaaccccagttgaggggcatcctagaaaacacctgactagtactcctcaaaaacatcaaggtcatcaaaaacaaggaaggtgtgggaaattattacagtccggaagagcttaactagccatggtgactaaatgtgaatcctggatggggatcctgaagcaaaaataaaacaaacaaacaaaaaaaaaacatgttaggttaaaagtatgaaaatatgaataaagtctggacttaagttataataatgattcaacatttgttcatttgtcgtgacaaatatgtcatactaaagtaaaacgttaacaataggatgagggatatttggaaactctctgtataatcttcataagttttctgtaagcctgaaactattctttaaaaaaaaaaaggtggggctattttatgtatctctttataggcttagttgaatttctcagacaaggagaaaaaaaatttgtttgtagcaaaactcctcaaagagatatccacacgtggtgtctctaattcctttctgcttgtatcaatctgttctggcactgctataaagaaataactcagactgggtaatttataaagaaaagaggttgaattggctcacggttctgcaggctgtacaggaagcatagtggcatctgcttggcttctggggaggcctcagaaagtttctaatcatgggggaaagcaaaagggcagcaggtgtttcacataacaggagcaggagcaacagagattagtaggggggtgggggtgctatacactttttttttttttttttttttttttgagatagagcttcagtcttgttgcccaggctggaatgcaatggtgcactctcggctcaccgcaacctccgcctcccgggttcaagcgattctcctgcctcagcctcccgagtagctgagattacaggcgcctgccaccatgcctggctaattttgtatttctagtagagatggagtttcaccatgttggtcaggctggtcttgaactcctgacctcaggtgatccgcccgccttggcctctcaaagtgctgggattacaggcatgagccactgcacctagccacacacttttaaatgaccagatctcatgagaactcactcactatcacgagaacagcacaaggggatggccctaaaccatgcaggagaaatccacctccacgatccaactgcctcccaccaggccccacctccaacactgggcattacagttcaacatgagatttggtggagacacagattcaaatcatatcacctcccatcctctctcgcctatgcctactccaaccagtctgcccccaccaccaccttctcatcactccactgacaatgtctttgtcaaagttaccattgttctccagcttgctaagtccatggtcagttctcatctctagtcctagctggcccaccagctgcacttgccatgggtgattgctcactcttccttgatttactttcttcacttagcttcaggacagcatgatgtcttggttttactccttcctcatggattgctccctcagtctcctttgctggttcctcctctcctccccaaacaccaaattctgtggatccctgggctcagctcttggtcttcctttttatccatactcatttccttcctttttttaactattattttaagttcaagggtacacgtgcaggtttgtagtataagtaaactcatggcacgggggtttgttgtacaggttattttgttacccaggtattaagcctaatacccattaattatacttcctaatcctccccctcctctcaccccttatcctcaggcaggccccagtgtgtgttgttcccctctatgtgtccatgtgttctcatcatttagctcccacttgtaagtgagaacatgtggtatttggttttctggtcctgcgttagtttgctaagggtaatggcctccagctctatccatgttcctgcaaaggacatgatctcattcttttttttctcaccagtatcgtagcttcaagtactgctgaatgctgatgactcccatatttgtatctccagcccagccctctcacctaaactccaaactcttatatccaactgacttcctaatgtctcaacatagatgcctcatatacatctcaaatttagcagatctaaaactgcattcctgagcctcaatttttttgaggctcatttgcctcacctgaggtgatctcacctgccaaaactgccttgcctatcccatctcagttgatgatgacatcatccttttagtcactccgaccaaaaatcctgacatcatctttgactcctcacttacttttacactccatatccaatccattaggaaatctaattcatcctaccttcaaaatgtgattataaaattatatatgaagtacctgtaatttcctaaattgaaatattattaacccacgcagcggggtaggggaaggggtccacctttccctccatctcttaatattaggatctaacacaaagtggccctggcgtccttccccgcttgaatgctgcctgcccccagcacatggctgcagcacattagcctccaaccctctgaagttctagctctaccccgcctaatttctatgtcctgtactcaccctgatgtgtccttcattcctgccccagcctgggctcccacctcccctcctgccatttcctccctgctcctttgctcttggctaccctggctccctcctgtccccacaatgcgtacatcttcctatacacttcacctctgaagtaggaggtgtccccagctggcctctcatcccagattatatgtcaatctagacaagtctccttgaattctttgccactgccaggtcccagaaagtctcttgctaagaccttgcaagccaatgaggttatcccagcttctcttctatatggctcccatttattgaagctgcaccaagaggtgagttcaggtcctagccttccccttcctggctgtttaatggggaaaataaaaacgcctacttcatttgccaattctgaggattaaataagatgcctggcacataacagtcacacaataagtgtttgctgttgttaccctgctgttactactgccctctgcaccacgcttcacatgcatgctctaatttaatccctgcattgtgggctgagatttacaaatcaagatgtactctcattttttttttaaagaaattgaggctcagaggggttacaagtgagatttttttgaacatgctgcagctagaaagtggcaaagcagagattcaaactcgggtgggcctggccctaaagtgttagcccttgctatatgatatactgtatcctcaaaatgactttctctggggaagagcaaatccataaaatgtacatacattcacactccttctaaaaagtaataaggggccaggctcagtggctgacgcctgtaatcccagcactctgggaggccaagtcgggtggatcacttgaggtcaggagttcaagaccccatctctactaaaaatacaaaaattaggcaggcatgatggtgcattcctgtaatcccagctactcaggaggctgaagcgggagaattgcttgaacccaggaggcagaggttgcagtaagccgagatcgcactactgcattccagcctgggcaacagagcaagactgtctcaaagaaaaaaaaaagaaagaaaaataggaagtaatatggaaatatatagcaaaaagtcttacagatgcttgtaccatttataaaatgcctaaataaaacagttggagttatgtataacaagatattattagtttctcttttgtttgtggaaatgcacatgatgttttagtcaattactatttctgctatctcaagacaactcctggccaggctcagtggctcactcctgtaatcctagcactctgggaggccaaggcaggtggatcacttgagcctaggagttcgagatcagtttgggcaacatggcgaaaccctgtctctaccaaaaaagaatgaaaaaaaaaaaaaaaaaactagctgagtgtggtggtgtgcacctgtagtcccagctactcgggtaaggaggatcacctgaggctgggaagtggaggttgcggtgagccaagatcttgccactccactacagcctaggcaacagagtgagactgtctcaaaaaaaagaaaaaagaaaaaaaaaacagataaaagaccactcctttctctgggttgcagggcataagaaattacaatgggtacacaagacatcaaggaacaaagagaccacaagtcctctgcacacctcccaggggcaacatgactctttgaaatagatgtgacaccctctggaggagggggacatgaacagtctctgttggggaaagtaactagggtcttaattttctcatttctattgcaaaatgtcatcatccagaattctttccaataacacatcagcccctttgaatttacctcacacattttttaaaggtgttgtttgcttactgtctgttttttcctttctactctctctcccatcctgttgtttctatatttgatacaaatatttaaattaaacatagtagaaggatggtttgcattagggcttatgttgcacttggccgtgatgcccagggcccaggtgcacgtgcctccaacagcagggcagacacctgttagccagtgatttttttattagaaaaataatacaagaacttctaattaaagatggcaaaatgaaagtgatgtagctccactttcttcttggaaacccacagccttccttctttgatgaaattagaaagcagtttcaatcctgggccacagttggttttgaagatgtggatgggagggtaacagggaaacccactggaaagggttaaggtgcagctcaagtgaaaacaatagaggtgaaagctccaagcacagagcctggcacatagtaggtgctccatggcccttattcatgaaggacgcttgttttcttcaagcagagggactgctaagcttgagccaggaggaagggtgtggggaagagccagcatgaatgagggccactgccaggagaggtgtctctttctctccctcacacacacacacacacacacacacacacaacacaaacacacaccaaaacacaaacacacaccaaaacacacatacacatacaaacacacaatatacacacacaaacatacaacacaaacacaacacacacaccaacacatacgtatggaaacacacagatacacatgtacacacactcaaatacatacacacacatatacatacacagaaacacatatacacaacacacacacgtacacaaacacacagaagcacaccacacacgcacacatatacatggaaacacacacacacacacacacacacacacacacactttctccacgagaaggagcagaatccaggccaaacccatggaatcagatcctggggcagaaccagccacgagtcagccagtgggcggggtcagggagatctggaggacatgtggatgacttggggggtggcccccactcaaaccagacccctctgtcctttgacatccccagccttcagtccaaaccctctgcctggcacccaacttgaggctggagagagggtgtggctgagcttcagccctgacaaaagccgcacctctctgccagccacagctgtggcccatgggagggagctagatcctgggctgggacctgaaaggtctggccccacccagcatggcgattatcttgacatgtaaacttgggcaagttactctccctctccagtcctgaattttcccttctgcaaaatgggagtagccacattgccttgtcttcctccaaggggatggttgtgtggctctgctgaactattcataataggaaattgctttgtgactcgcccaaaacattagtcactgtgattattagcatcatcatcattattgttcctcaatccacatgccaactgtcctccaccctctctctcctcttgccctctggaaagcagctgagttgacagtggaaggctccccagcactcccacgagtccttccctgacttacctctctcctccaagaacctctgccttttgccagctggtattgagtcaagggaaggcccccgctttcatcccaaacattctccccccgactgaccaccctgatgaagtggcaagagccctgctcatcaaggggctcactgatggtttgggggcatatctcatcctctctctgacctcagctgcctcatctgtagagggaaagtgttgatgcaaacttcacagtgttggcatgagcactacacaggatcatgtaagataaagagcccatttcaggccggatgcagtcactcatgcctataataccagagctttgggaggctgaggtgggaggatcacttgcgcccaggagtttcagaccagcctggacaacatagtgagatctcatctctacaaaaaatgaaaaaaatagctagttgtggtggcatgcacctgtagtcctagctactcagaaggctaaggtgggaagatcacttgagcctgcgagagcaagccttcagtgaactgtgattgtgccactgcactccagcctggatgacagagcaagaccctgtctccaaaaaaaaagcggggggaatagggtacaggtgggggctggacaataggctctgggaagcttgtcattgcatttgtctgtgtagtgtagaatagctaaactatccagacatccatcaataagaaatggttaagtgaaatacaacacatacatagagtagaatactacacagcccttagaaagaatggaggaaggcatggtcagagttcttggttgcaagcaacagacatgccacacctggctgatatcagacagaccatttcacaagtccagggtgtaccatccacactgggttctatgtaaatacccccctcctgctatgttttttgaaactgtgaaacttagaagctttgcaaagataccagggagtttatagaaataatgattagaggctgggcatggtggcttatggctgtaatcccagcactttgggaggccgaggcaggcggatcacaaggtcaagagatcgagaccatcctggccaacatggtgaaaccccgtctctactaaaaatacaaaaattagccgagtgtgttggcgtgtgcctgtagttccagctgctcggaaggctgaggcaggagaatcgcttggacctg[132 bp omitted]gtcagccgaggtcaccggcaagaatcatctggtcaggattttttcagtggctctcaatatcatccccatcgtaaatggctttccaactgttcctgcacctttggcttattctctcaagactatatccccaaggaaaaggcatagaataattaaacctcagccatgcattttatttattaacaaacactcatgtttgtacatactatataccaggcactgttgtaagaatgttaagtggattgtctcctgattgctttatttgaatttatttaatcctcacaacaattctatgaggttggtgctattattaacttcattttctgaatgacaacactgagacaacttgtccaatttatttgacaaataagcaaacctgggattttaaaccaaacaaactggttttggagcactacactagctgcctctacaggcataggagacgtctagaaggaatcacaagaaatcattctgtggtaatctctagggaataggattaacggaagcaggggatcttttttcacttgatcggttctatgctatagacgttttgtttatttattttttgagacagtctcactctgtcgcccaggcgagagtacagtggtgcaatctcagctcgctgcaacctccgcctcccaggctcaagctatcctcccacctcagcctcccaagtagctgggactacaggtgcatgccaccatgaccacctaatatttgtatttttagcagagatgaggtttcttcatgttggccaggctggtctcaaactcctgagctcaagccatctgcccaccttggcctcccaaactgctaggattgtaggcatgagccactgtgtctggcctaagttttattttaatgacgaccctggacggcttgtatggtgaaaatatttttaatacaaaggttttatctatctgatttttgtttgtttgttttagtctgtgtatgtgaagccaaaagctgagctagctctgagggaaggagggctagggcgcgcaatgagccaccaaggaattctgccagggttggagttggaaggacaatttgttgggggcctgagatgagaaggaggaggaggaggtgattgccgccagtcttctgcagttgctcttaaacttgagcctgcatcacagccacccggagggcttttggaaacgttgctgggccccacacccagagctttaaactagtagatccagggtgtggcccaagaatgttcatttctaacgtgttcccagatgatgctcatgctgctggtccaagatcacactcagaaccacagctctacccttatgggcagcactgtacaactttttttttttttttttttttttttttttagatgaagtttcgctcttgttgcccaggctcgagtgcaatggcgtaatctcggctcaccgcaacctctacctcccgggttcaagcgattctcctgtctcagcctcccgagtagctgggattacaggcacccgccaccatgcccagctaattttttatttttagtagagatgagatttcaccacattggtcaggctggtcttgaactcctgacctcaggtgatccatctgcctcggcctcccaaagtgctgggattaacaggcatgagccatcgcctggcagctctgtacaacttacagagcatgtgcacgttacctggtctcatctagtcctccccacagccctgagagagaagggggcaggcaagggcagggcagctatacctgctgtgttgctaaggggaatgaggggtgcccacctcgccgcagcctgccatgccccagttatccggtacccaccacccctccaccatcagctcccaccacactacctcacccagtgaatgccagctcacaagccttctctccgccccagaacttcaagctttgtttatcccagaaggcccccacatctgcactctctccccctggaacaatggaaggctgcctccctctcagacctcagttcaaatttcgccccctcagggagtctcccttgaccacctcacttaatcacctctcccctttccaggtgtcctctatacctgtgatgagtgacgcagtggccacaaatcacatggggctatttaaatttaaattatctaaaacagaacttaaaattcagtttcttggtcacattagtcacattgactgctatgttggacagcaaggatatagaacctttccaccatcacggaaatcctgtggacagcgcagctctctacccttactcaatttcatcatcttcccagcaatgatcactagttgaaaccttattcatttactgacttgttgtctgccctctcctagaacacaagtttcttaaagacagtgtaggactctctttttcaccactgaatccccagtgttcagcacagtacctaacatattcccaaagcaggtattcaagaaacatttactgggagggtattttggggggcaactgccaagattaggaattggagtcctgtaatagggaacaggggtcactcagattatcttgttcatctgggagaaaatacacctcaattattatctgcatagtgtagttagttgttagcttttttctgtctatatcctctattaatttccatcctcatctcagctgctgggaagaacacgcatgccctggctgcctagagagggataaacagcagcagttccattcaccgcttcaggaaaaagaaccatcttggacctgggaaagagcagagcaagggatgaggtgggctggagatgggattgtccatggcaggaggaagaacagaaagaaacagtggctcatggatccgggagttttaaatgagcttgggataccctagaatgaagaatcagtgcccagctctggactgacacagtctggacttaagtctctgctccacggcttatttgctgtgcaaattactttctgggactgggtttctttgtctgtaaattaagaataacaatatatttttctaattaagatggttatgggaattaaatgggttcttcataagtccttagaatttcaggcccttagtatatgttcttttttatcaccttttccaaagccccagggctgccactcacctcccgcaacaaaaaaattgcttcccagcagttgctcctcatacctccccttccagccttccctctcctctccagcacatgtctctggactaaaacccttgtgactgaacctgccttctctgcccagcccctggtgactcctaacaaacttgtaatgcttgccctggcattcacatttgctttcccatttgctgtttctcagcttagctcctcacgtccgctcatgtggggcgcaaggtctagtacacgcccacacccaagatcctgagaccctagtctgctcccctgcctggtggaggacactgagcccttgcccagcactcatgtccatcaccagaagctttgtgtctcctttcttcctctgatcacttgtgcagtgtcacccaggagctgggagaaacaaagattcctgggccccactgcaggatgctgcattttaacagaccctcaggtgattcataagtccatgaagtcttgtgggttagaaccactaacccacaagcccttgtcatgggatgcagcatgatccacctgggggactgagggcgactgtcttctccagcctcaccctccccacatgcccttgaaaagccactcgagtcctgtgcccaggagccctctcctcctttatcatctgcggaatgtctacccttccttgctggtgcagctcacttgccacctcctccaggaagccttcctgggctccataaagctgagctgcttatgccctcctctgtgtatttaacagcaatttgcttttcattgtgtgatgtggccgaacttcttcattgggcctggggatctgaagccacgccacttcaaatgagtgggagggtgtggaaaaagggcaagtaatggcctgcagagaaaggggcccttcctgatcatccactgtgcatgttcacattcatcaatgacttcgctctttccttttaacctatgaggttggcgttgcccacaggttttttttgttgttgttattgttttgtttcttggttttgtttgtttttgagacggagtctccctctgtcgcccaggctggagtgcagtggcgcgatcttggctcactgaaactctgcctcctgggttcaagcgattctcctgcttcagcctcctgagtagctgggattacaggcacatgccaccatacccggctaatttttgtatttttagtagagacggggcttcaccatgttggtcaggctggtcttgaactcctgaccttgtgatccgcccgcctcaacctcccaaagtgcttggcattacaggtgtgagccaccatgcctggcctgctcacaggttttacaagaggggacactgaggcaaaagtgtcccatggaggctgtgctgctgacaaacggcagagcggctcctgccattcacctgcactgtatctcgggctttgctttggtctactccataaacttcctgaaaaaggtttctttgaaaaagtccaaatttgtccctaataactgaagggtagaaatgtgaaatgggcctactctgggatcaagaccacctgggttcaaaccctaacttggaagctctgggccttgggcaactaactggcctctttcaagttcagttttccctcctgtaggttgagaggtttcaacgagacaacacagatgaaaggcacagcctggcccccagcatgcaggccagtgtttggtaattgatagttttctctcctgtttcactatcctaggtccaaagaaccagaagagtagacagtccttagagacagcagctgtgccggctgcagaaatggagagagctgtgagctagaatagaagaagagaaaggccaaaaaccacggagaaacagagccagacaacacagaggtgaaattcagaaagcgagtccagcacttggctgaagttacaggcccttcctgccctgccctttcccacccaaggccatgcctagttcatgttactaagtctaagaaacagctccagaagtggcatctctgctaaccactagggaagatattgtcgttttttaatgattcaaactctccagggaaccaagaaggctgagggcgctgagttctctccacacacctgggctcaggactcccccaatatctacgtgctttattcctgatcttaacaggctctgaaagccacataaacccgtgcttgcctgggtaccaaaagacccgggcccgggggtctttgttcgggctcggtgccttctccatctaagctttcttggcagtgttactctcctcacactgttacttgggttctcactttctgttcttgagttaatggatgtttgttttcctgaattcacgggtcctttgtaagtcttctatcccataacgtaagatgggggtataaacaaagaagcaagcgctagctgaccttatgtggggcatggttagggaacaggaattccctgtatccagcagggttaagctggtaggaggaaagggaaatgagagaaaggaatcaagaagtgagaaagggaaccagtacctgtcaacaccaacacacacctggtaagtagcagggctggtcttcaaatccaggactatggggccactgcatgggaacagaagcagcttgtagacttcggtggtggggctgccagagtcggggaattaagggaggacaggctctgcagcccaagtgccagatgccaacggcctgcgaaggctctaggacccagctccaaatcagtgctcccggcgccatccagtggccattagggagattgcaagagaaaaaagcatgagaaaagaaaccccagagaagccagtgcctgccaactccagggaagaggaaggaaggagcctggcctttgccctcagtgccccctatcagttgactaccctgctccagtttgacctccccactaggcttcttcctggtgcaactgatgttttctctctgtgtgaccttgggcaggcaactctggcctctaggcctcagtttccccaactgtaaaatgaatggtaaggcaaggtgaggtcacatgccaagtccataggtctttagctcatctgatcctcatggccaggtaagatgatcattcccatccccccatactccagtccctcctgaccacgcatagttcaagcttcactcacctgtaaagtcttccatggcctcctgcggaaattccagccaccgtttaaggatcacctctccaggatttctccctcctctcatctgaagttccctctttctgcaacagtcaggtggacctcagcccttctagcccggagcttcctcagctcaagagtttttctcaatcatcagtttctccctcttcaccaagcctagcaaggtgcccggcacagagtacttaagagcagctgctctgaagtcagtcagcctggcttcaagccccatgtggtaggcagaatggccttccccacaaagatgtacacattttaatccccggcacctgtgatttcacctcacacgacaaaagggactttgcagatgtggttaagatagagagcttgaggctgggcgcggtggctcacgcctgtaatcccaacactttgggaggctgaggcaggcggatcacctgaggtcggaagttcaagtccagcctgaccaacatggagaaactctgtttctactaaaaatacaaaaaattagctgggagtggtggcatacacctgtaatcccagctactcaggaggctgaggcaggagaatcgcttgaacccaggaggcggaggttgcagtgagccgagatcgcaccattgcactccagcctgggcaacaagagcaaaaactccatctcaaaaaaaaaaaaagatagcttgagatgggattatctttgattatcaaggtcatgccaatataaacagaagggtccttataagacagagacgggaaggtcagagtcagagaaagagatgtgctgatggaaactgagtctgaagtgatgtagggccatgacccaaggaattcaggtagcctctagaagctggaaaaggccaggaaacaaaagcctctagaaggaataaagccttgccaacacatcttagacttctgacctaaaaactgtaaggtaataaatgtgtgttgctagccactcaatttgtggtaacttattagagcagccataggaaacatcctggttcagcttcgtactggttatgttactgttggaaacttaacctttctgtgtctcagtgtcctcatctgtaaaatggggatgataaaggcaataattcttatttcactggttccaagtataaaatgaaaatacctgcaaatcagttacaataatgcccaacactaaatatgttagctgttactataagaacagttaatagctaccattaattgagggataggtacaaggcacatgccttagaagaatgtccttgattctccccatcacgcttgggggtaacaattccagtctccactttgcagatgaggaaacaaacacaaaataattttccccaaatcactctaggactggaagcattttaaacttcgttgtttcttacatgcactcgggaaatggtactggtttgtgttctttgctgatagaggtgttttgggaggggttgataagatgacagaaggaaggccacaggctggacagacaggggtcctagctgatacctccttctcttcctacctagtgcaggagagagttaaaatcggtcaaagctcatctatccactcccaccccatccatttaggggttcaattactgcctctcactttcccaccaacgccacccccgcaccccttaccagcgctcagtactagcagcttttgagccagatttgggggcatcatgggataggcgtggccgggagcgaagcgttcagtccgctggggaatggagtggcgcagacttactcagaccccaaggattcctgttgagccccctcccttcccgcagcctgcataaggagccatctgttctcggctgaataaacaagcagggggaagcagcgccgggtctcctgcccccgagcccgacccccgcacaatgcgcctttctccaaggagacgccgcccgggcgccgccacagcacgctccgtctggcttcccctcccccaggcggcgcagcaagacccaaaaacggaccccgtggaaatcagttttttttatttttttaagaacacaaacaagaaatccaacaaagaactgagcgcagcacgcggcgagggcgtgccggtctagcacgtgccccttccctcaccacccgctatccccctgacgccgcagtccgcctaatggtccgggcgaggccaactcagctcaatgccggaagcccgccagcgcctccgccccgacagcccaagccggacgggcccaggttctgcctggccccggcgcaccgatggcgcgcaaggggcaccgtccgtggtgccgcgccccagcccgggtctgggccgtccgtggccctcacttctggttggccagctggttctccagatcctccaggcgcgccgtcagctgggccagtgagcggttaaggaggccgttggggttcgccgaggtcccttcactttccctccagcccgcgccaccagccccaaaggatatggttcagcgtcaggctctcgagcgcccccagcgtgcggccctggaactccacgaggctttcgcattcgcatgggctccgaagctctgtccctgcgctgatgccctcctctgcaagccggacacagagggtcagggggatgagaaattgccctagctttggccctctgatttccctgcactgggcctatggttgagtatatgggctttggatttagagagacctgggctgagtcccaagctaagtagctgtgagatactgaaaaactcactaacctttctaagctcagttttctcatctataaaatggatataatgaaagagtgtacgcattagtggcttcgaggattcattcacctgtgtacgtgtgtgtgtgtgtgtgtgctcacgcacaacttacaagactgtttctcaaaccttaatgctcattggaatcatcaggagagcttgttaaaatatagattctgcttcagaatggagaagaagctcagaaggtacatttctaataagctcccaaatgatgctgatgctcctggtctgtggaccacactttgtgtagcactctccaaataaaattttatgcaatgatgaaagtgttctacatctgccctgtccaaagcagtagctacaagccacatgtggctgtttaacacttcaaatatgactggtgctactaaaggactaaaatgtattttattttaatcaattgtaattaaataggtactgcctacctttttgaaaaagcacagatctagaacactgcctggttcaagtaaatactttacagcaggggtccccaatccccaggccatggaccagtaccagcacattacatggaccagtaccagcccatggcctgttaggaactgggccacacagcaggaggtgagcagccagcatgcaagggagcttcatctgtatttatagctgctcctcattgctcctattacaacctgagctcctttcctgtcagatcagtggcattgttagattctcatgggagcacaaaccctattgtaaactgtgcatgtgagggatctaggttgcaggcttcttatgaaaatctaatgcctgatgatctgtcactgtctcccatcacccacggatggcaccatctagctgcaggaaaacaagctgagggctcccactgattatacattatggtgagttgtataattatttcattgtatattacaatgtaataatagaaataaagtgcacaataaatgtaatgtgcttgaaccatcccaaaaccattctccccaccaccatcatggaaatattgtcttccgtaaaaccactgcctggtgccaaaaaggttggaaaccactgctttatagtgtatttcaactagaccagtgattctcaaagtgtggtccttggaccagcagcatcggcatcgtgtaggaatttatcaaaaatgctaattatcagacaacaccccagacttgctgaattagaaaatctagagttgaagcccagcaatttgtgtttgtttttgttttgttttttgagctctgtctcccaggctggagtgcagtggtgcaatcttggctcactgtaacctctgcctcctgggttcaagtgattctcctgcctcagcctcccgagtagctgggattacaggcatgtgccaccatgccctgctaattttttgtatttttagtagagacggggtttcactgtgttagccaggatggtctcgatcccctgaccttgtgatctgcccacctcggcctcccaaagtgctgggattacagccatgagccatcatgcccagctgcaatttgtgtttttaaaggtccaccaggtgattctggtgtgacctaatttttaggaaccactgatcctgatccaactctatctccccacacatcaacatcttgggggttgggcaggaggccttacaattaaaactggcacatgttttttcttagcagtacataaggtagtgatgaatcttaaaatgaatggtatcttagattcactgaaattctataagcatgtgccattgttaagattacagggaggccaggtgctgtggctcacacctgtaatcccagcactttgggaggctgaggcgggtggatcacgaggtcaggagatcaagaccatcctggctaacacggtgaaaccccatctctactaaaactagaaaaaattagccgggcgtggtggcatgcgcctgttgtcccagctactcgagaggctgaggcaggagaatcgcttgaacctggcaggcagaggttgcagtaagccgagatcgcaccactgcactccagcctggatgacagagcgagactccatctcaaaaaaaaaaaaaaaaaaaaaaaaaaagattacagggaatgacatagaaaaaaaaaatgctacaataaaagtaccttaggaaaaaaaagaaaaaggattacacgtggtgaaataataagcacaatacctgccatttaacctttgaaaacactgccataatgatttaaaagttgtctcttcatcttagtcttatatgtactatgaacaaactgctggaatccagcaaagacccctaacttcacagatttgtttctctaaacaaagggttggagacagggaacagtcataccaccaattgataaagagcttcaaccacaaaacccagacttctcttagaactctagaactagaggtaaccttgggcagccagtgcctctcctgttaccgaagagaaaagttaaggtaggtgtggggtaagtgactcgtccaaagtcacactgcagggcccataagagtcacataggaagagctctgaaagagcccctaatctgaaagagccacaataattagaattggctgagagcggggagggaaggagagttgggggaaggactgtatgtgtatatttgtatgtgtatatacatgcacgtgcatgtgcatgcatacacaaacacatattatataatatagtatatatagtatattatatatactttttttgagacagggtctcactctgtcaccaggctggagtgcagtagtgcaatctcggctcactgcaacctccacctcccaggttcaagcaattctcctgcctcagtgcccaccaccttgcccagctaatttttgtattttttggtaaagacagggtttcaccatgttgccaaggatggtctcgaactcctgatctcaagtgatccagccgcctcggcctcccagagtgctgggattacaggtgtgagccactgcgcccagcccccctacatatatctaaaaaaaaaaaaaggcaaattctccagacccaaaccagccctacttagtctgtttctggagctgcagtctgataaatgggaagaagagtcacatcttaagcctgggctagtgtctaaagtctctagggtaaaagttaccctggagacattccctgtatcacctagagcacagtacactgcatgcgattcaagagtccccttcttcacaggtagagtcagtctctttttcctcagctgagcaccagatgatgaagtagagggattgcacttatgaggtatgttgtccccaataaaaaaaaaaaaagtctttgcatacttaaaatatattcagtcctgccactttgccaagttcataaggttgaattctaacaagttcagggatatatgctgtggctccacttacaaatgctgtctggtgtgccttcaaaaaaatttcccaaattattctgaacctccactgatttgggggacaggtagcctagtctaggatttcttagactttaatatgcttacaaatcacctgagaatcttgtcgaagtggaaattctgattcattcggtctggagagcaccagaaatgtttcagttctaagaagctaccgggtgaccgccctgccgctggcctgcagaccacatttggagtagcaaagctctgtctagtgagcccaacctctggctataactacaaagtgggcagggagtgaataggaaggggagatatcagaggacgggcaatgagagagaggaggagccccgagagagatgcgctcacctggacagatgctgcctctgaggttctccagcaggtgcgtcatggtgccgaagtccggggcataggacacgtgcagttccgctggctccgaggcgatctcgcgcagctccgcctccaccgccttgcccacgcccacggcgtacatgacgatgcctgcaaggccggggtctcagagggtgccccaggcctcgggaaagctgcctcccagcgtctgacccaaccccagcccactgtgtcccatgccaagcccaccttcctccttggcgcgcgctgcccacaccgagatgtcatcctgggagcggccatccgtgaagaccaggccaacacgaggcacgttaagggcacggggccgtgcaccctgcgcctcggagaagctgtgctccaccatgtgccgcaacgccagccctgtcatggtgccgcgttccatgtactccacggccaggaccgcctgcttcacctcggctgcggtgccgtagcgacccagagggaactcggtgcgcacgcggctcgagaactgcaccagccccacccgcgtgccctcgggggacacatctaggaagtccacaatctggttcacgaagcgcttcactagctcgaagttttgtggacgcacgctcttggagccatcaaccagcagaacaaggtccacgtggccttcccggcaccctgcacagccagaaaagcttgaattgagggaccagattctggactggcagcagctgtctatccatctagtcgttcattcgcaaacatttattatataacagacaacatttcctgagtccttcctgtgccaggcagtgtgctaagtaataataattatcaccatcatcatcaccatcaccatcatcatcaccctcatcatcgcccttgacatttattcagtgcttagaacaaaccactctgctaaaagcatctttttttaacaacaatcatagtaatgaccacaataactaccatttattgatcatctactatgtatcaggcacacttctaagcactctaccagtattaacaataataataacaaaaacattatttaccgacagcttaccatgtggtaggtactgggtgaagtgcttatatatattctcaatcctcccaataagcttgaatattgtccccattttctatgacctgaggttctgatggataaagtgattgccccagatttcatagctagtactgactgagccaagacatgaagccaggtccatctgactccaaaacccatgctcctgaatgactctacaatgtcacctcccctattctgagccaggaaagttgctaggcccaaaatgtggtgtgtgttggcgtggggaggttttcaaaggttttgaaataattaaaacataatcctgttccatgaggacagagcagagcaagtcagacatgctatgtgctctggtcaaggaaagtgctagaagagaagatcatgcagggatcccaaggtaggaatagtgtattcttcctggagttgttaaggaaggctgcatggagatgatggccttctatctgatctttgttatgaactgaatgagtgtgtttcccaaaattcatttattgaaaccctacgcctttatgtgatagtctccggaggtgagatctttggaggttaattaggattagatgaggacatgagggtacagcgcttatgagtaaaattactgtccttgtaagagtctgaagaggtcaggcatggtggctcccagcactttgggaggctgaggcgggcagatcacttgaggttaggagttcgagaccagcctggctgagatggcaaaaccccatctccactaaaaatacaaaaattagccaagcatggtggggcacacctgtagtctcagctactccagaggctgtaacaggagaatcagttgagccccagaggcagaggttgcagtgagccgacatcgcgccactgcactccagcccgagaaacagagggagacttagtctcaaaaaaaaaaaaaaaaaaaaaagtcgaagagggcttgcttcctgtcttcaccatgtgaggacacagcaagaaaattggtgtgtgtgggtgtgtgtgtgtaggggtgtgtgtgtgtgtgtgtgtgttggcgtggggaggctttgaaaggtgtgccatctaagaatcagaaaacaggccttctttagacaccatatctgctggcaccttggtcttggactcctcagcctccagaattgtgaaaactaaatgtctagtctacagtactttgatatagcagcctgaatgatctaagacagtcttgaaagatcagtaggagtttgccaaggcagtaagggacagtctagaaggtgagatgcagcacgtgcagaggcttgggatctggggagatcctgacacatccggggaggggcaggccagtaagactgaaatgttcaagtgtggcaggagatgggcagatggagttggctgaagctagatcgtgatgacctaaggcagtggtttcaaaatttttatcacagcccacagtaaaaataataataatgacaatacatcatgagacatttcacacagaactaaaatttcagaaataatataactctttctacaggcagtaaactctatattgtcttccactcttttttttttaatgttggttgtaacccagtaatttgatttcattattcattaatgtggttctgctcaccatttgaaatacttaggggtaagtcatttgatctttctcctgtagtcattggtgagccacagaaggcttgtgcacaaaggaggaatgtgatcaaatatgtatttttaaattaacattgacagcagagtagaggattgtaggaaagagatggaaggagggaatggcacaccctccaatgtcacccccacaacacacacagacattcacaccacagcctaggggccacagcaatggcaaagtcaaggacactccaaatgtgggcaatggggcagaagccaacagaacaccctcccgcccatcactcacggttgcagctcttgccatctgcctgaagttgccgcccctcggggcacaggcagcggtaggagaggccctcgctcacacactggaactcacagccatggtccacgccattgcaaaggtcccggactgaaaggagagacaggtcaggatgagtcaggatggaccccaccagctaagatctcttacccctcccacaaatgtaggagagccctcctcaccctgacagctcctcccatcaggctgcaagtcatggccctctctgcagtggcaccgtggcccaccaggggtgctaacacactcatgctgacagctatggttcccaaagctgcagtagtcaatggctggcaggagggaagaaacagcaagatgttgcctctgattggagccctcggaggccacagtccagggtgtggtgggagggtgggggtgttgctcacccctgcagctcctctggtcctgctggagtacaaagccaacttggcagtgacagaaataggagcctggggaattgacgcagtggtgctcacatccatgggtcccttcagcacacagatcaatggctgaggaagaaatggggtcagtctatgcccaggactgcccttctcagctctggtagcacaaccacctaaggaaattttaaagaatacctacgcctgggccccaaccccaaaaatcctgacctaattagtcagggcccctgtcctcaagatgctctctgacttacagaggacaggtttggccactttacctatttgagcctccatttttctatttgcaaaatgggaatataatggaagacagtgattgctattcacagcttccttccatggaagatggggaactattgccctgttgagcatcttgatgatctggataggcaaagatggccgagagctggactggagagaagataattaccctgtataaaaaagtgagtatttggggttcctggaaaggagatgagagtggagagaggaaagaaaaaaaaaaaaaagaacaagagagccagtatgaagatgagtaactctgtgggttgaggctgcctgtgaaaaatcccttgtactaggctgactgaggactttcagaaacaaagctgtctaatattcaattataatgagtttttcgtgtgtgtgtgcacgcgctatgagttacttagcacatacacgcttgtgtatgcccctgcatacacaagtgtgtaaaccaacgaagaggttgattaacatgcatggaacaagaacagcatgtgcagggttgagaaatgagagaggatccataaatcaaatgaatttagcagaggctcacagcaagaggtgacaaccagaagataagcacttgggggatttccagaggtcttggagagagatttgaatgttaaacagtcatcaaatcagagttcaagccaacttttagtttctagaaacaagaagaccccagctgacatctgggttattgggattacatgatttctttttccaggttgttgtgaggctgagagataataacatgtgtaatgctcctagcacaatgtctaatactaacttggtactcagtaaaaaactgaattgaataagcgaggtattctatgccatagcttttcagaagacaaaaatgaagaagcagctcacacctgtaatcccagcactttgagaggccaaggcgggaggatctcttgagcccaggagtgtgagaccagcctgggcaacatagcaaggccctatctcttaaaaagagagagtcttgaaagatttgcaaaggcagaggggagtggcaagggcagctcaggtgagcagcacacaaagagctgaggtgcagagtcaagaatgggtggcatgaggggggacacccacctaattgaagaccccccaacagtatctaagaagagaaactgtaaggatgtgcctgtaagaagacagaaatggccgggcgcagtggctcacgcctgtaatcccagcgctttgggaggccaaggcgggcagatcacttgaggtcaggagttcgagaccagcctagccaacatggtgaaaccccatctccactaaaaatacaaaaaatagctgggtgtggtggccagcacctgtaatcccagctacttgggaggctgacacacaagaatcacttgaacccgggaggcggaggttgcagtgagctaagatcgcaccattgcactccagcttgggcaatagagccagactctgtctcaaaaaaaaaaaaaaaaaaaaaagagagagagaaaagaaaagaagaaaacagaaacaagtttgggaggttgattagagactggcctgaaaacagggagaaagagggcagaaagcacactgaactgtgggctcccaccagggacttatgtgaccccaggcaatacctttctttcttaggcctgtaaagtgatggaggtgtgcttttactgccaaaggcccttccagactcattggtctgatgttggggcaatggagagccaaagaaggttcaggagcagtgagattgcaggacagggatagctgtcatccaaacagctcttgttatctgctgctagcttgtagcctgggttgcaggtgcagtggaacatggcccaggcattgacacattggtgctggcaaccatgtcccccctcagcacactggtccttccctgaggacacacaggactagaatcagtagggaacagatgggcagaagcctccaacaagagagagctggatggggatggggtcagaggcaggcatcaccctcaaatggctttcagaaggaaatgactaatttgagaagggccgtaccaagtgagagggcttagggaaagaataaggcttaaggagcccctgtgagtaggctcagaagaggagacactcaattagacacgtcagtgggctgggacaggactacacaggggcaggagtgggtaggaaggtggagaggtgctaagtcgaggtgggcggaataaactcaaaacagatcagaacagatcttgcagcatttgtgggaggagctaagatgataatgggagaagtcatccccatgtgggagggccacgactctttggagcagccgatccctcttagctttgagaatcactggttccgtgtgtgcagggggttggtgctggaatttgacattaagcctgtggtaagctgtggcgggtagggcaagaaattataggttgctccttgttgatggaggctgagcagaagtggtcagagctgaaatctgacacagcctgcggtaggtcagggcaactctacctggaaatcgcggggccacccccacgggatgggatttactgtggtgggaaaggaatccaagcatttggattgagagttcgagcttcactccagcgccctcctaactcaccacacagccggctctggaactgcaggccgaactcctggatgaggtcgaaggactctacgaggaagacgtgctcgtctagcgggggcgatgccatggcgcgcagggagcccacgtccgcgcgctgcacccccaccgcgtaaatttcaatgccgcgggcgcgcgcctgtgccgccacctcggccacgcggtcctggggccgcccgtctgtcacgatgacagcgacacgcggcacgcgctcctctggcggtcgcgcgccctcggccacactgaaggccacgttcatggcgtactggattgccagtcccgtcatggtgccttgcgccagaggcaccaggtcgcggatggcgcgctccatgtcctcgcggcgagagaacgcgcggagagggaagacgctctgcacttgactcgaatactggatcacgccaacgcgcgtggcgttgggacccacgttcaggcctcggaggaggcccatgaggaactgccgcatggtctcgaactcgaaagggcgcacgctgcgggagctgtcaatcacgaacaccagatccaggggcccagtgtgacacctgggacctgcggggagatcagggaggactctcctaggtcagcaaagcctcacctccgaggagaccccctaggaaacccaggggaaatgccgctatgccgacataacagcgcccagcacagcaaacgcagattagacagatgcactcgcccggcatgtgcctagcacctgggctaggagatttcacaaattccctcatcttacagatctgagggctattctgaggcggtattacccattgacgagggggcaaggaagcgtcgcaaactcaaagcctgcagggaccaggcagggaacatggatgaactggttgggttaggacgctggagacccaaagagcccctatcactcctaaattgggcaggtagctgcatccaaatgaggccatgcccctgcgaattggatgtcagcagatccctggtttttcaagagaaatactaaacagggatttttatgtaaaatttcctggtttttttccatgttttcaaataatttttccaaattaaacaccccatgggcagttctgcatgcgcccaaaactaagccacatcctacagatgaagaaactgaggcccagaaaggtgaagtggggaacttaaacccagtcccatatgttccaaagcccttgcttccctctccccagcaggaggagctggctgcagagggaggacctgcttccgctcccctcctcccactggtgagggctgggccccagttcacctgtcaactggagctgggtttcccagggctgaagaaggagcagcaacacgggccagcaaagaaggcctctcatggcgcttggggacagagaatggaggtgtcagagcctggagggaggaaggaaaatagaaaagcaacagtatttacagagctcttattctgggtgataggcacttggagggggaagacagttacaggtttattttactaatctctctatttttgtgtatgtttgaaatgtttcagaattaaaaaattctcatcacagtgggattgctgggaaacacaagagattctttttttttttttttttagatagagtcttgctctgtcgtcccggctggagtgcagtggcatgatctcggctcactgcaacctctgcctcccaggttcaagcgattctccggcctcagcctcccgagtagctgggattacaggctcctgccaccacacctggctaattttttgtatttttagtagagagcgggttttgccatgttggtcaggctggtctcaaactcctgacctcaggtgatcctcccacctcggcctcccagaatgctgggattacaggcgtgagccaccgcgctcggcccacaagagaatggtaaataagaatagatacatagatacaaatatgcaaaatttaaacagaaaaaaacaggtcttccttaaatgtcaggcacagtgttaaatgctcttcacgcattgtggcatttaatcctctctgcaattgtaagactaaggctgtgattgtcccccatcatacagacaatgaaattgaggctcagaaaagttaagcgctggtacccaaagtcattcggccaaaaagtggctgcggcaggatacaatcccacgcctgctagtttctgtgagccagcctgggcgtttggtgcctctcctcctgccaggcgaacctctgcagacagaagcccttccccacctcggcccactcccctacgcacacaggcttctgtgtggctgtctttgcaactcgccaacccccccagacccctccacacacacaaacacagacatgcactgcccaaccgcaggcggcagggaggggctgcgccctgttgcggggctgagcgtggtggcgtggcagcgagtggaccaaaacccactgcgcacgagaacgcgcggcttggcgcctgtttcccgcctgctctcaggagcgaccgccagggggcgcccgagatggcagggggcgtgggaagcccacatctgcccagcaggtgcgcccaccccgagcaaacagggggccggggcccggggccttggagataaggcctggacaggatataacccgcgcaagagccgaggagcaggggtgtgcagggttccagcgacagcagcactggactcgtccagagggcggcgggtgagcggctggggccccgtggagccaccatggaccccgcaggggcagcaggtgagcgcttaccctcccgaggccccggagacgccccgtgagaactacgaaggaccacccccccaccccctccccactatacaaataggaaaactaagccccaaggaggcagcccgccgaactgcaaaagcaggattagaacctagggctcctggttccccttctctctcttgaggccccctggcgcctagaattcactaaacctcatttccttccagctcctaccccaccgccgcgccccatgctgaagctgtgttagccatttttctgttgctgtttcttggcagagagggccagctgcccctaacccaacagcagctccgcccccgccccccaattccgtgaatgcgcctattctgagcgaggccagtgcctgcttctcactccaggcgaccttctcatcccggattcttctcccttttcccctcccaggcctggtagaagaacataaatcctctggcagggcccgtcgtgggagggtgaccaagcaagatgtggcagcgctggtggaagtgggagggcggggaacccttgtcaagcttgggccacaggcaaagccaacatccctggacagcatgagggctaaggcacaaggggcctctgccacctcccatactttcctacccggagatgcctctgggcccctaaatcttggttaaggttcccctcatcccattcttggtctgagccaacttctcacctggcaccctgcctccaccccaggaatcctagaaagtcaaaatagcaaatgcctcaaagttcatcacctttccaaacccctcattctacaaagaaaggaactaggtccagagagggtagtgtcttgctgaagggtacatggcgatgtcgtggcaggactgatactagaacctgggattcctctgaggagttaatccttgcattaaaaaaagaaagattcagagatgccctgaggtgaggttgagggagtggagcagcaagggaggagaggcctgtaaataaattctcaaaagtcccttagggacatttcagggggttcctggagggatgagagtagaaaagggatgatcctattttgatggctttgagggtgggggctcgatttggaaaggaccctgcagaagtggggaagggcactgcaaatcagatagggcaccctaggcagcgtctctgctaaaatacactcgcctgacctggcttgatgcctactcccctgcagacccctcagtgcctcccaatcctttgactcacctgagcctgcaggacagatcagagatgcagctgcagagcgaagccgacaggcggagcctcccgggcacttggaccaggtaacggcggcgtggcagcgtgccctaggtggggactgccaggcagctggagcacacagaggcaacggccgcatttaacccagggctggcgggtggggaggggaagtgcaggctgcaacccctcccactggcagggagggatccccccttcctcctgagggggggcaaacccagcaccccctgctcctaccacgcttggagctgcagacagggctagctgcgggccaggctggaattcagctacagcgggagactggggagaccggggcagccacactccacagccggaattcattggaagcttagaaggcacttccctgaggagagccccaaggggtggagcggtcctggctgtggctgctgcctgtctggcctggctttcgagggtgcggtcttgcgctgtcccctccaggagtgaggagagactctggtcctgccaagaggaataagggctcagaaggacagcctcagttttcatggctctccttgggcctcaacctgctaaccccccaaatctctcccacctcccctcctctacttgctccctgcaattgctcgggcctacccacccacaccgctcaagacccccaggttaagaagccaccagacctctaggctctaacctggctcactctgcaggaccaatgtcatctgccttgactcctgtaatcaagggtaggaaagcccacacagcaacaggccacttctcatgggagaaagggaagaatatggctttggccccagaaaggctcagattcccccaggccatcccccatcctgaggacaaggttttgggcccttttctgtttgcaggcaggaggctagagagcgctccaggccaggagcccaggaaaggctctcccttcccctccctcctcaccccccaccctgccttccccagggtggggaagcttcatctctaccaattccatcagccctaaaatactcttctccatcccaaggccagtataagtgcagcctttgtgtcacagccacgtgtccctatggccctgggctccaatgggcatgatgccagacccacagagtggaacctgggtggtcccatgggttccatgcaggcttcgttgagcaccttgcagcctaaatatttagcctacaatttgcagccaagtctcctccttacctaatgcttcctcttcctgaccccacaggggcaggatatagagcagccccaccctcccactcactctaaccccctgctcacttcattttactcaacctgagtgcttggaccctgtgccaccttgacccttctccctcctgtggctggtcgacctgcctgccctactcccaggtcatccccagagcacaccaccattctgaggggaggcgtgcgcaggtgcctgcagcaacagtgtgaacagactgtgcggatcctgcatgccaaggtggcccagaaatcatacggaaatgagaagcggtaggtgcctccgcagcccctcccaggtctctgcaactgtcagccctatgcacctcctccatccacccattgggcctcttttagacgcagagcaggcctcagggctgagatctcagctattggtcgaccagggccttgaccctcagccaccattagcccccactttggtctatagttctacagcaggagattccctgtgaatctcctgtctccattcattcactcattctcccattgattcacttattcattcattcaacaactacttactgagtgtttgtcatgtatgcaccaggctctgtgggtactgctgggcactgggcatacagctgaacaagacagaaacagcccctgctctgtagcccacactctcactcaagtgtggaagagacagacagtaaactccccacaagtcaggaaacaagatacttgcagattatgatgagcactagaaggaaaactgaacgaggccatttgacggaaactgaaggcaggggggacattagctagaaaggtcaaggaggttgagagaccttttgggaggtaacattggaactgaaacttgaatgctgaaatggagccagacaggagaatatctggggaaagcgtgctacaattagaaggaacagaagggccgggcgcgatggctcacacctgtaatcccagcactttgggaggccgaggcgggcggatcacctgaggtcaggagttcgagaccagcctggccaatacagtgaaaccccctctctaccaaaaaatacaaaattagctgggcatggtggcgggcacctgtaatcccagctgctcaggaggctgaggcaggataattggttgaacccgggaggcggaggttgcagtgagccgagatcatgccactgcactccagcctggcgacagagcaagactcagtctcaaaaaaaaaaagggcaacagaaaatgggaagaccttgaggctgtaccaattaggcctgtttgaggtacaaaagaaatgacagtggctgaaatcagagggaggagttgtaggaaacaagtcagagaggtaagcaggggtcagatctcaggaggactttgaattttaaaccagtggaggattttaaggagttaacatgatttgactcatgtttttaacaaaacactctggccagcctggtggctcatccctgtaatcccagcacttcggcagacccaggtgggcagattgcttgagcccagaagttccagacctgcatgggcaacatgacaaaaccatgtctgtacaaaaaacacaaaaattagatgggtgtggtggcttgtgtctgtagtctcacctactcaggaggccgaggtgggaggatcagttggggaggcagaagttgcagtgagcccagacagccgagatcaagttactgcattccagcctgggcaacagagcaagaccctgcctcaaaaaaaaaaaaaaagaaaaagaaaaagaaagaaacaggaaggaaggaatgaaagaaaaaaagaaagaaagagagaggaaggaaggaaggaaggagcactctggctgctgtgcgaaatgggaaggagatagaaacagaactttctggaaatagaccagtttgaaggctgatgctgtggtccaggcaaaaagtaatggcggctgggatgaagggcgaggtggtaaaaagccagtggattctggatatattatattttgaaggtggagtggacaggaccttctgatgagttgaatgaggggtgtaaaaacaataaggtttggctatgaatggggtttacagtcgtgaaaaagcgttgcggggagcgggaggaggaaacgaaggttctgctgggtttatgctactaccttgccgtgcttacaggagagccaagtggagatggatgcacgactccaacactcacttatctccgcaggttcttctgccccccgccctgtgtctacctctcggggcctggctggagggtgaagccagggcaggatcaaggtgagggcggaatcaagggctgccggccgcctgctctgtagggaggaccacgagattgggcccgagacggggcggttcgcaggcgcagtctccccgcgccctctggcggcgagcgctaagcttgcctggcacctgcgtcctcccgagtccttgcagagccagttcgcgtccctttccagctcaccaggcgggggaaacggggcccacggtctgcggttacatgggactggacagcgcgtccggcagcgccactgagacgcagaagctgaatttcgagcagcagccggactccagggtgagagcgcacgggaaggggtccgattcctgctcccatccctgcctctcctgggaaaggagggctcctttactcccctccgaaagccaagagataggtggggagaccgggaggccggggtcctgccttaaggccgagcctgagagcctggatggtggagcttctggtcacctccgacggggcggacgtccgatatctgggagaggttggttcatccgacgggggagggctgggatgagatggccctgtacctgtgagccccctaggaattcggctgcgccaagaccctgtacatctcagatgcagacaagaggaagcactttcggctggtgctgcggctggtgctgcgcgggggccgggagctgggtaccttccacagccgccttatcaaggtcatctcgaagccctcgcagaagaagcagtcgctgaaaaacaccgatcgtgagcagggcggggcctgacccccggcccgggcggggaggtgcaaccaagcccagaacggctaaactggggcgcggaggtgggggtaggctgggcttaggggtcagagtggaaaaggtggagtcggagccgagaggggaaggagtctggatgagtgggtgcggcccaggcctggggatgagaagagttggaggatgaaaagcagagaggaaagggacagataccaaattccaggttgggagttggggtcccagagcagacaaaagttgaactaggcaggagttgaactagggacagactaaaagtgacataggtggggcacggtggctcatgcctgtaatcccaacaatttgggaggccaaggtgggcggatcagttgatcccagaagttcaagactagctagggcaacatggcgaaatcttgtctgtaccaaaaaaaaaaaaaaaaaaagaaaaagaaaaattagcctggcatggtggcctgcacttgttgtcccagctacgtgggaggctgagatcagaagatcacttgaacccaagaggtcgaggctgcagtgagctgtgatagcaccacggcagtccagcctgggtgacagggtgagatgctatctcaaaaaaaaaaaaaaaaagttttacttttgtttgttgaactgaaagatgtccagacagcaaaggaacaggcaaaggttccaaagcaggactgcagcaggtcctggaaaaacagctgtgaactgggaatgcccagtgtatctaggcctgtgggcacattagccaggccggcacagggacagaagattggaaactgtctggaaagtccaaggaaccaagccaggacagggcactgatagcaccaactaaccttaaccctcaccctgaccccctccctcaccctaaccctcaccctaatcctaatccttaccctcaccctcactctaaccctcaccctaatcctaaccctcaccctcaccctaaccctcaccctaaccctaaccccaatcctaaccctaaccctatcccctcaccctaaccctgaccctcaccctcaccctaaccctgaccctcaccctcacagtgtgcatatcctccggctcaaaggtctccctcttcaaccgcctgcgctctcagacggtctccacacgctacctctctgtggaggatggggcctttgtggccagtgcacgacagtgggctgccttcacgctccacctgggtaatgacatctgcaggccctggagctgggcacttcacatgcattagcttatttaacctccaccacaactccttaaggaaggtaaactctgccccatgtgattaaggctcagaaacacaaaaagacttgactacagtcccagtgagctggtgactgttccaagctattctgactcccttatccatgccctttccccatatatcaactaagctgcctgcccccaacccctgcccccagggcagacatttgtgaggatggcctcaaatggcctctccagaattagaaccttcagttggctcccctgagtaccaagctttcccgcagggcccatgtgtgatgtgaggaagagccagaggcaacaaggcagggtttaaggcagaagcttgggggccgctgaaaaccttgtcccttgctttttttgtcccccagctgatgggcactctgcccaaggagacttcccaccgcgagagggctacgttcgctatggctccctggtgcagctcgtctgcacggtcaccggcatcacactacctcccatggtataggaagggagggcatgcctggaggggtcccctcagatccatgcagagaatgtggcacacacgggcagggctggagagtgaggccccaaggcatggagacacctgttctcacccagtgtcgcgtaggaccagacagaagtcaaagggcagggggaatctgctagtgcctgtgtggctattggagtagcagacagccggctaggagggcagcctctggacgcccgggctccttgccaccactgttcttaccatccttccattgcagatcatccgtaaagtagcaaaacagtgtgcgctccttgatgtggatgagcccatctcccagctgcacaagtgtgcattccagtttccaggcagtcccccaggagggggtggcacctacttatgccttgccacagagaaggtggtgcaatttcaggtaagaagcagagaataccagcaccaagtgtcctggaaagggagaatgcagagaaccacagaatgtaagatcatcaccctcaccatggttgctacttcctgagcagcctcccatggaacattaaaatcatagactcccaggacagaatcataggatgtagaaaaatagtaataagtaatagtatgaagcaatattccttcccaaagaattttagagtcataaaatattgggatatagccaggtgcggtggctcatgcctgtaatcccagcactttgcgaggctgaggtgggcagaacacctgaggtcaggagttcgagactagactggccaacatggtgaaatcccatctctactaaaaatacaaaaattagctgggcatggcagtgggcgcctgtaatctcagctactcaggaggctgaggcaggagaattgcttgaacctgagaggtggaggttgcagtgagccaggatcacaccattgcactccagcctgggtgacaagagcaagactccatctcaaaaaaagtaagtaaataaattgggatataaaattgtaggatgtaaataaaaatcatgataggtaatagagagcagagaattaatgagcaaagactattcgaagcacagataaagacacagaatgtggaaaattatagaatgtggaaaataataattatcgttaagcagtagtactcccaaaagaatattatcatagaatgttacgagatagaattataatatgtggaaaatagcaagtattattccttccccaagaatattccttcccaaagaatattaaaattgtagattattagagcatagaattgcacaatgttaaaaaaaaaaaaattctggaatcccaagaaaaaagacccttagaaatcagctatcccaggccgggccaatggctcatgcctgtagtcacaatactttgggaggctgaggcaggaggatcacgaggccaggagtttgagaccagcctggccaacatggtgaaaccctgtctctactaaaaatacaaaaaaattatttgggcgtggtggctggcacctgtaatcccagctacccgggcgcctgaggcaggagaatcatttgaacccgggaggcggaggttgcaatgagccaagatcaggccattgcactccagcctgggcgacagagcgagattcagtctcaaaaaaaaaaaaaggaagaaaggaaggaaggaaggaagaagagagaaagagagagagagaaagaaaaagaaagaaagaaagaaaagaaagagaaagaaaagaaaaagagaaagggaaagaaagaaaaggaaggaaggaaagaaagaaaaagaaagaaaggaaaaaagagagagaaagggaaagaaaaagaaaaggaaggaaggaaggaaaataaagaaaaaagaaagaagaaagaagaaagaagaaatcagctagctcaacaagctttcttaacgctaagtgagagaacttaagggcactgtccaagctgaggggacaagtgaaccccagagcctaggattagtatccagttcggtctaacgcagaagcccacgcgccatgctggctccctacactggtggccaccatgagaagcttcggcctcgtccccttgggtctcctcccaggcctctccctgccccaaggaggcgaacagggctctgcttaacgacagctcttgctggaccatcatcggcaccgagtcggtggaattttccttcagcaccagcctggcgtgtaccctggagccggtcactccggtgcctctcatcagcaccctagaggtgaagccgggcgctaggggcgttgggcagggggaccctgcctgcactgggcagtggtggtgctagtgagtggggggcagcgggttcccgccctacttggttctctcacctcacctggtcccaccctcccccagctgagcggcgggggcgacgtggccacgctggagctccacggagagaacttccacgcggggctcaaggtgtggtttggggacgtggaggcagaaaccatgtacaggtacggggtggtgaggcagcctctcttgggccccggggagcaggggaagggggtgcacgcgtcgtcggagtcgccgcagccctcaccctggtgctccacccccaggagcccgcggtccctggtgtgcgtggtgccggacgtggcggccttctgcagcgactggcgctggctgcgcgctcccatcacaatccccatgagcctggtgcgcgccgacgggctcttctaccctagtgccttctccttcacctacaccccggaatacagcgtgcggccgggtcaccccggcgtccccgagcccgccaccgacgccgacgcgctcctggagagcatccatcaggagttcacgcgcaccaacttccacctcttcatccagacttaggcgcgcccggtagccccggctgcccaccctggagggctgcgcccgcgccaggcgcggggacgtgtttctgggttctaggccctgcttccttgcccctttgctgcagaagggcagctgaaggctcaccctagaaaccgggcctggtgggtcttacccggctcactccctcccttgtccttacacatacaggaagacaagacctgagtggtgctgtctttgtgtccgtcgtgtatggctctccctgtcttcatttcttctcactctgtctctaaacctctctctctctcccttccccctcagtacttagtctacagacctatgtgcgtgtccctatccttctgtccttttctctcttcagctctccctgcctctcacacacaattttacatgccccgaggagccaagtttgggacatttaccctccaggcatctgtgtcccctcttgaagagaaaacacacagcttcacacatccaggcatagggggcaagctcttggggcatcaggaccctggagcaccaggtccttcctggaatattagatccacctggagcaccgggtctctctaagtctcacctggggaattcggtcccacctggggcaccagttcccacctagagcactgtgtcctgccctagagcacaaagacctgctcctcccgagactctctctgactgcagccaggcatagtacctttgcctgtgtttgctccctggtccacagatttggtggctgggcaggtgcctggacagtgatgaggtcttgccgccttaactgtcccccccagtcacttctcccacaggcccagcaggacgcagtcctgaggatcagggattctacagctgcattaaaatcaatcctatccaaggcagagtttggtctgtatgagccacctccccaagtgtgcctcccccaaccctcgcaccaacacacaaaagaggggacctgcacagaaagaaaagaaccacaagtctgatggagcagagagcctaccttttggacgttttctagaggaggaacagggtgcagaggcagctggcatcctgagtccctgtccctgccctggggttgttaccctactagctatctctccatcccaagcaagggtgcaccccaggcccagaggtgaccacgggaccctttcaaaacaaagctttcccaggatagccctgggcagaactcctgggattgactgggcagtaatgtagttgagaggggggcctctctgcatggggctgatggacagaatcacaatctattccccaccagcctacccaccctaggtaccactctacccagtctgtgctttatagggaaggaaaaaaaaaccaggcagaacactggcttgggctattggaatcaaggacacagataagtatcatgggtgccagctacctgcaccagcctctggtggtgcctgatgggaaaactggtctgaaatgtgggttctaggttctaaccctctggagaagagcttgccctcctaaggaagagctcatttcttgtaaaactcctcccccagggtatggaaagtcccatgagaaaaaagaaacgaacaatacgcagaggagaggaaatggggtatgttctttagccttcccaaagtcttgactaagttctgccatctgccatcagcaggctgcaacccactgtgaggggtgaggaagaagcctgtggcccctgaaggtgaatcttggctgaggaaggcagcaaatgagttgaatgggaaatgtccctgaaatgagcgcctgactcaccgtccatggtggtgttgaagcaggcagccaggagggaggaggctgagaagagtgtcatagcgcaccacatggggaattggggctcaagcgctcatcgtccagccctgcccccaaagtcttcctccaccactcctcaaggcaggagtcccagaagccaataatctaggttggaccaaaagcccagacccagccatacagctctgtcttagtcctcacccatctcaggggatcctataacctttggtgtccccaaggtatccatctggaagtctgtgaccaaagctccagccctggcctagcttctgagttccagctgctgaaactgtccttggaggtcttccttgcactgagtctgaagccatctaacatcaaactcctttccctctccacctgccttgcagcaccacctctagctccttcccccacaccacccagtcacccaggcctaaggatcccacccccacttccacactaccatatgcctcctgttttcctctccctccactactgccctgccaggtcctgtgtcgcctcttccaaaatttcccaaactactctaggtagaactagctatataatttgtgggccccagtgcaaaatggcccgttgttcaaaaattattcaagaatttcaattcgactgaacacgggattaaaaaaaaaaaaagaacttcaagacagccacaggaaatgatgaaaccaagtgcaggggccttccaagcacaggctgcacaaccacgaagccagccctggccccaggcttttttcttgtattcccacagaccctcaatgggaccatatcgactgcctgctttggatcaaaggttttacctacatgcccattgtctcctctaggctgccatcttcatggggaaaggagctcttatctctgcatgtcctaaagggtgcatcacaatgcctcgcatgttgagttggtgctcaataaacagtgaattgcattatatggcattggcagatatttagatattgctaatgcaaagtgaaaccggcaggtggcactgttctccacccgagcattaagttctcattttatttatatttaaaaaccgggccttaatcccagccctttggtaggccgaggcgcaaggatcacttaagcccaggagttcgagaccaccctgggcaacataacaagaccccctcccccatctctacaaaaaaatgtaaaaatagggccgggcgcagtggctcacgcctgtaatcccagcactttgggaggccgaggcgggcggatcacgaggtcaggagataagagaccaacctggctaacccggtgaaaccccgtct[133 bp omitted]cactccagcctgggggacagagtgagactccgtctcaaaaaaataaaaaaataataataataattagccggtgtggtggtgcacgcctgtagtcccagctatggggtgggggcggggggatgctgaggagggaggatcactggagcacaggtagtggaagctgcagtgagctgtgattgtgccactacactccagcctgggtgacagagggagaccctttgggggtttatgcacagaattctacatacttccagggaatttcctaacactaaaacccatttatggattaatttagtcctctttatattagaatcatttgccacgctataaaaattaatataccgggccgggcgcagtggctcacgcctgtaatcccagcactttgggaggtcgaggtgggtggatcacctgaggtcaggagtttgagaccagcctggccaacatggtgaaaccctgtctctactaaaaattcaaaacattagccaggcgtggtggcgtgtgcctgtaatcccagctactcaggaggctgaggcaggagaattgcttgaacccaggaggcagaggctgcagcgaactgagatcacgccactgcactccagcctagggtctctccagcagagtgaaactccgtctcaaaaaaaaaaataatactaataatataccggccacgccatggaacaattctattaacatctctgagtgtggagctcaggcatctgtattgtttgaaaccctcccatgtgaatctagtgagcagccagggttaagaatcatggccctagtcagtatttcctcctcattttatagatggggaaactgaggctccaagagaggaggctaaggtcacagcagatggcaaagcctacaattgattcaaatcctgcactcctaccactaaatctggggctctgagtttctcttcattctcattctaccacgctgctgtgtgtaggtgacatgtgtgttgcagagggtggggatggggcatgtagtgaggataaggcccaaatctccaatttaccagctctcatgctgcctggtgttccaccattattaacaagctagttccccagtaagtaccgaccttggggtttctctctctttctttctttcttttttttttttaacttctattaagttataaccacagcataggtaaaattctctgacagcttccccctgggtagggcacagacctgtgaagatggcaagggaaagaggaagtggttttaagggaagtgaaacccataatacatctataaggttgtggccaggcatggtggctcacacttgtaatcctagcactttgggaggccgagccaggcagatcacttcagatcacttgaggtcaggagttccagaccagcctggccaacatggtaaaaccccgtctctactaaaaatacaaaaataggctgggcacggtggctcacacctgtaatcccagctacttgggagactgggacagaagaatcgcttgaacccaggaggcgaaagttgcagtgagctgagatcacgccactgcactccagcttgggtgacaacaagactctgtctcaaaaaataaaaaatacaaaatgtagccagacgtggtggcgtgcacctgtagtcccagctacttgggtggctgaggcacaagaatcgcttgcacctaggaggcagaggttgcagtgagccgagattgtgccactgcactccagcctgggcaacagagcgagactgtctaaaaaaagaaaaacaaacaaacaaaaccatctataaggttttgccacagaccagctcagaacagcctcctagacaggcttggccctgttccagaccctaagggacaaaggcaggcagggtagcagtggcacaataatgcatttagagggcaaagtgataaacccccactacagctggctgcttgccaccagatgggcactttcacctttgctatctaatgtaaactaatcataaaccttgtggcatcccatcatatttacaggtcctcaaggagagagaattatacaggttgtatatatagggcagaaatcttgcaggccatcttagaattctgtctactccccaaacaacatagcaaatcataagtaggggagatgtgtttcacttgtaggccttcccacaccccatgcaggcattgtcccatggttttgctacctctgaagattggcaagatcatgaacaaaaagtgggcccatgcctggcttctgtaatgtagtggttatcacattcgcctcacacatgaaaggtcaccagtttgagaccgggccaaaacacgagattttccccctaaatttagtgagtttaatcgaggttggaaacaaacagaaaactagttaaacctgtgcctacattttggccgggtgtggtggctcatgcctgtaatcccaacactttgggaggccgaggtgggcggatcgcatgagatcaggagtttgagaccagcctggacaacatggtgaaaccctgtctctactaaaaatacaaaaattagccaggcattgtggcacatgcctgtaatctcagctacttgggaggctgaggcaggagaatcacttgaacctgggaggcagagatagcagtgagctgagatcataccatggcactccagcctgggcgacagagtgagactccacctcaaaaaattaaaaaacaaaaagtggaccaatagtgtccaaaatccattttgcatccactgcccaattctcagaaatattatatattatcagaaataaccagagttggctctccagacagataaagccctagtcgaggttgaccactgatggggctatgtctgccagcatttaggatggcttccaatgagtcttgtatccaggtgctcctgcccctgggtggtctcctgtcacaatgaatagggctgacccatgtgacccatgcaatattatggaagagatagtgggtgacttccaagctaagtcataaaagtcactgtagcttccacttggtggctctcttggatcgcttgttctgagagaaaccagctgccgcatcacgaggactgtcaatcagctctatgtgggtccacgcaatgaggaactgaggcctcctgccaaaatagccagcaccaagttgtcagaaatgtaactgagccatcttggaagtggatcctccagcccagtcaagctttcagatgacagcaagacctggccaacgtcgactgcaacctcacaagatggagccagaatcgcccagctaatgctcctgacttctgactcacagaaacaatgtgagataatatttatgttgttataagcccctaagtttgggggtaattttaaatatcaatagataatatgggggtcttctttttttttttttctttttgagatggagtctcgctctgtcgcccaggttggagtgcagtggcacgatctcggctcactgcaagctccgcctccccgcttcacgccattctcctgcctcagcctcccgagtagctgggactacagacacccgccgccacgcccggctaattttttttgtacttttagtagagatggagtttcaccgtgttagccaggatcgtctcaatctcctgggggggtcttcttaaactaatactttacccaaaaagatggcactgatgatgagaacaccatatattgagcacttattgtgtgctaagctctgacttgcctccctataggctgttggatcacaaggtaacagctggtaaaagctgaaacccaaacccagaggtcctgactcagtctcacaccatccaaagcagccctaacaggaatttctacaactggaaatgttctgtgtctgcaccacctgatacagtagccactagccacatgtggctgttgagcacttaaaacaaggctagtgcaactaagaagcagaatttttatttttacaattataattaatttaaatttataatatagccacagttcccagtggctaccatagtggtcagcacagatctaacagatgtgagggccttctacaagacacaagttaggagaacagagacccactcaacctcatgggactcagaaaaacagtgtggcaaagtctcaggagagatttaagctgccacgagatttaagaccagaatcactggttcagagggggtttgcaggggcatgaacagcccccagtgagggagccttgggtgatataaaccccttgataggcagtgcagttgttagcactctagagcccgactgccggggttcaaatctcacctctacaactggtaagctgtgtagctttgagcaaggtatttaacctcttagatgcagtttccctatctgtcaaatggggttactaatagcacctactctgtggagatctgacaattaaatgggatctggtataaagccctaagaatgggttcctggccacatggtgtgtatgggagggtttgctccaactaccaccaattcctgtttgcgtcctttccccaaccccagcaaagtactgggcaacatggtgccaaaggaagatcaccaatgtccaaggacctgaaattaaggttcgactctccagacacactaggggcaggttgccctcttggtaacaaggatcttacccacctcacagggttgttatagtggtcaagaaagatggcccatgctatttccggagactgccagccagcctggctgcagcagtggcctgagtgaagcaggcggagacagtggtgcggagagcccacatctagatgggtgcctgccgctcagcagctctcttgttgccatgcaggctgacagttgccaattttttttatttctttttcccaagaaaagtgagaaatctggatttttatgagaaacctcctgatttctatggatggcaactgacgcaaagatttttgtgtttgctatttaaacacagtgccacctaaacaaaaccttgaagtaggggtgatatgctgcataggccatcagggtgcatgttctgaagtcttccctcttctctaggccccttcctgccttcttacctctctgcccccaccctctgcccacccccggcatgtctggcaccccgtaggggatttggtccggggagtttcttcatgctccactgagatcaaggggatacagagcccaaaaaggatgacttgttatgaacgaaaatgacagaggcaagcagtttagaaagtaccaggttttattatctttttatcaaaaaaaatcagtaacagacaacagtgtgagaggtgcctacagaggaggtgctcactccaacacagcccaaggggaagggcactgggggcagaagaggacccagccagctgggaccctgggttgcagtggtgacgggagctaatggccactggtgcagcaagggagggtggttcccctcaccgcagccactggggtcaggaggagacacgacctgcccaggctaagccaccaggcctcccctctcaggagagggagggtcccagacaacaggccccagctggggcctcatcagccctcccccattcccccccccctacccagggagacaagggtcgtcccagcacagctgaggctgtgactcgttaagccagtttagttctctagaatagtgctgtccaacagatggacatgctctcgctgtcagtacagtagccatgaactacatacagtgacgcctctagaaacgtggttagtgcaactgaggaaggaatttttaatcttatgtgattttaattggcttaactttaaacagccgcatgtggttactgtattggatagcacagccctagagcctgaagaaagcaaaccaaagaacaccagctgggtcccaaacagaaggcagaaagggtagaaccatccacctcaactattccagccccatcagaaggcaccaggaacagggcaagagaaaaaggcaaaaacccacccagccacatgaaaattcactcactcaaccacccagcaacatcaaactggaaacaccacactatttcctgaaaaaaatatatttatctatttttctagaaccaaggaagaataataatatattataagaacacagacacaaatatcccaccatccccttcattatattttgggatctgctaaaaaaaaactatgtttcggcaaaagctattttataagaggaagcagcttcagaaagggccaaggccatgaggagcggggtttaaagtataaaaaaaaaactggggaaggggtttaatgaaagagaacaaagaaagaagaggggaagggaggccctatctaaagctataaatagtaaaaaaaaaaaaaaaaaaaaaaaattaataaaaatcatctctccggctcttctctcattttcaagaaacaaacaaaaacaaaaacaaaaaccattaaatacaaacttagcaggtgctgtggaaatgtgcgagagaatgaagacacctcggcacctccacactcttgcccaggcagagatatacactctgcacaaaggaatgaacagttaaaaaaacgaacaaacactaaaaatagatttacaaatattctataaatccatttcagcataaactctcagctcttttccccatcctcccccccaaataaaaaaggttgatttccaaaagtcacttgaaagagcctagaatggccccaggtatataccacagagattcccgtagtgtgatcacaagtacccatttacagaaacatctcaaggtgcaggtggttctagttccttcccccatttcctggcagagagaccggctgtgaaaggaagggaggaaggccactgggggaggacctccagccaggactccacacaacatccgttagccccctggcttcagaggagctctggatgaggcatggtcagtatgggcttgagggcggacctagattcttaactggaagtttaagaagtgatccaatcccagtcttgccttcagaaaggccaagttgaatccatttttctgccagggcaactgaggcccaaagctcaagaagaacctggcagaacagtagaagacaatgtctcttctgaacacttcaaaggtaatcagagctggagatactgacaagtcagtattaggttgacctcaccctaccctaatgtccacccttcaaaatcccctggcttccctccccgctaaagtccaagccagtgcccacaagcaagcttcacgcgtagaactcattggtgggggctttcttgtagatgggtttcttgcccaggtcatagctgccttcatccttcttcttcatacggtacatgagcagtaggatcaggaagacggcaaagaggatgcccacgatgccacccacaatcagagctggagaggaggagagagaagaggcgggggtgagagctcctcatcaggacctaaggatgaacccctctttcccccactgtcagttctcttacaaccagacatcctcaccatcaccactgcctgtgccaggcaagctgatgccttatttaagttgacctcatgaccccagttataagaagtgggtcgttggcattttaagtcactgaagaccacagggctagtggtaaggccactcctttttctttttgagacgaagtctcactctgttgcccgagctgagtgcagtggcgtgatctcggcttactgcaacctccacctcccaggttcaagcaattctcctgcctcagcctcctgagtagctgggattataggcacgtgccaccatgcccggctaatttttgtatttttagtagagatagggtttcactatgttggccaggctggtcttgaactcctgaccttgcccatctcggcctcccaaagtgctgggattacaggcgtgagccaccgcactcggccaaggccactattttaacccacatctgcctgaatctaaagcctaggctctttccaaacaccacgcggactcccctgcaacagtctagcactaactgaaccaggaacaggagaaaaccgtaggctatggaaatccctgtagacatatttatcctgcagtccttagcacagggcactctctagctctccctgtgtgcatatttacctatatagcctacacttcatagacaggtatgtacattcaaagtgcacacatgcagaacatactaattccaaactcttatgttacaattacatacagaactcagtagctaaggcctggtttccactcctacctctcctacttcctggctgtgtgatttggggcaagtttccttcatctccctaccgcaaaatgggaagagccatacctttctcatacatttgtcctaaggattaaataaattaatccactcaaagtgcttagaacaatgcctagtgcatagcatattctcaagattcattaactgtaagggtttaaggtttatatctgtgtcccgaaccccctgaatcaggtgtgcacaacaggaggtgcttaataaatgatactttcaggctccgagaggagaacctgcctagtgttgggcagagatgggcttctaacagtgagtgggtctggcctgtccactctgccaggtggcctgaatgactcattcctgtttgctaggggcagggatgcttcatagaatcccttctgtggcagattgagttccctaattcggtcttactcgggctaagaagattaattttccatccctgcacacactacaaatctatgtacacaatggggacagagtggcacagaggagtcaagcaaggttctttcttgggtaaaatcctatgaaaaagcaacaaaaaagtacccccaggaggtgccagagcaagcacatggaatatcaggcatcaaccccattcttgtctctatcacctttccctctgatgaccccagttcctccacgaggccctgggtctgcgctgggatgccccacagggtcaagtttcaagcacaggctcagaagctgactgtggtcctcagtccaaatgccaggtctgccacttccagctttgtgacttcggataagttctttagactgagttttgtgttgtacggactcaatcaggggcacaggaatcatacagcatacagcaagcatttaataaggctcctgggtgctgattaaagcttctggaatgggggattccaccacaccagctaacaatataacttttcacatgaggctcttaggcttgtataattctcaaatggaagattaaagagataacctggcttcagttcttttcttactatgtggcctaaagcctgggcctcagtctccccatgtataagaagcaggtgcttagattaatcagtggttttcaaatttttctttagaagcaatagcacctttagttaattagagcaaaaccttatgcaaatccaaagtcttatgcaaatctttttacttctgaaagaaaagtaaaaagaactttggctcagataccaggaagccagggtcagggctgaggtgggcccagtcatcaggggctgtgctcccaggaaccctctttacaagaggcaggtgagaccttccatctgtcctggatgaagccaggctctgtccctatagctcaagcctccttggagctgctggctctgttgattcccaggagacaggagttacccagcatgggcccagggtgcccacttgccaggccggttcatccaggctggccctcggccatgaccttggggagttccctccatcccttttgtcaacacctgggacaaagcattcctcaccgcacattccagtaaagaactctcaactgaggccaaatcggaatagccctttatagtgtgcaaagttatttcatattttatttttcatggactcattatatcaaccccagaaggtatcactgtacccattttacagataaggaaactgaggctcatcaagttcgaaagcttctcagccaaggtcacaaggctgccaagtgatagagtagggggaggggaagctaacccaattcgaaggagcctccagacttacaagggaaattaacttttaatgattaactcccagatgccaaacttatacagtgaaagtcctttgcaaaataaatgagaaagacttaaggcagaagaatgactcaatgcctattttccagaagactttgataggtgctttttcctctccctccaccaggctgcacagtcagagccaccccataaggaaggtgtagtctttcaatgttctagggcaacctgaataggcaaaaggaaggggcaccaaggagcctcatggctggaggcatccctgcctgcaggtgctctcccccgctgagccccattccaccttcaaggcatcttataagcagcatggggacttacctgccaggacctccgttctctcaaagatgttgctgccctgcacagtgctggacattgacaccttgttggacacatcctcactctcttcaacgggtgagattctcttggggataacctcattctcctctagtttcttgggttcggtggggacttggctcccagaccctgccctctcagggatatggttatctagaggcacctggatgggcggaaaggagaagagacactcagcgtattttggaagagactcagggcaggggacagggacattcagccaggcagagaatctggttctgccatattcagctgaaccatatggtcctggagcaggaattggcaacactgtctccacaattatgctgccaaaatccttatccccaacttttttagtatatctgtcccaaatgaaaaatgaatgcacccaagggaacagggaagcaggtgctctcctgcactgctggccactggttattctagagcaaccactctggaagcaatttggcaaaaccttagacatcgcttgccctttaaggtggcagttttgccctggaaactctattgtaaggagctcttcagagactacgtgtaaaagatgcttgctgcagctcctctgcctatgaagtagccattcttttattcctttactgtcttaataaacttgctttcactttactctatggactcaccctgaattctaccttgtgcaagatccaagaaccctctcccttggggtctggatcgggacccctttctggtaacatctttctggagaaccacagaagggatgagacggaggagactcccgaatcaaaggaaatggactgcagcactgattggaggactttggatatcaccttttgtcagaactaagagttatgaatggccctcaccatactggccctttctgactgaacccctctctaccatggatacaagaggccctaatagttaagcaggaatatcatcaccctattcagcatgaagaagttatagaagatggatctttgtccctctgcaacccttaggattaagggttttcttacaaaagggagggggaaaatgtcaggtgtttgaaccagagtgcctacatcttgaataggggctgggtaaaataaggctgagacctgctgggccgcattcccagtaagttaagcatcctacgtaacagaatgagataggaggtctgcacaagatacaggtcataaagaccttgctgataaaacaggttgcaataaagaagcttgccaaaaaccaccaaaaacaggatggcaatgaaactgttggtctcactgctcattatatgctaattatactacattagcatgctaagagacactcccatcagtgccatggcaatttacaaatgccctggcaaagtcaggaagttactctatatggtctaaaaaggggaggagcccctagttctgggaattgcccacccctttgttggaaaactcatgaataatctaccccttgcttaacatataatcaagaaataaccataaaaatgggcaaccagcagccaatgccactgctctacctatggagtagccattcttttattcctttactttcttaataaacttgttattgctttgcaaaaataaaaaagatgtttgctgcagtgttataattttaaaatgttaacaaattataagccatttttccgtcaataaagggaatcaggtaaactattacgcagcctataaaaatgacaagagcattaaattatgcagggaaatactcatgaccagtctaagtgaaaaacgcagttcatagaattatatatatatactttttttttttttttttgagagggagtctctgtcgcccaggctggggtgcaatggtgcaatctctgcccactgcaatctctgcctctcaggttcaagcgatcctcctacctcagcctcccaatcaagtagctgggactacaggcgcacgccactgtgccaggctaattttttgtatttttagtagagatagggtttcaccatgttggccaggctggtctcgaactcctgacctcaggtgatctgcccgtcttagcctcccaaagtgctgggattacaggcattagccactgtgcccggcctatatatatacttttctatcaatgctaggaaatagctataaatgtagagaaaaggagttggtgttgacggtgactatccctgcagggaggatggcctaccagcaacctacaaaatgagcctggggccagatttgtttgtttgtttgtttgttttaacacagtctggctctgtcacccaggctggagtgcactggcacaatcttggctcactgcaacctctgcctcctggacttaagccattctcccacctcagcctctcaagtagctgggactacaggcacatgccaccacacctggctaatttttgtattttatgtagagacaggtttcatcgtgttgcccaggctggtcttgaactcctgacctcaagcctcccaaagtgctgggattacaggcctgagccaccatgcccaccccagggccagatttttaaaaagccttcccgcatagtggggtaagacccctcacttattctgcctatgggggctgtattttctgcctctcccaataggtctgctatagaggagcaaagtggaagaggcagaagcatgtagctacttaccaagggatggacaacttcagggccgatcatggagtcttccaagtcatctgtaaggtcagaatagctgtgtgagtgaggtccattaccccaggaaaatgaccccttcagccaggactggtgggagctccaccttacaaccagcttccaaatgctcaatgtccagcaagcgagcttccccacccctacttcagtcatctcatctgtaaaatggggctcctcagacccaccccctggctctttcacaggaatgtgtgagctggcagctgggcagaggcttcatcagctctaaacccttgctctgcaaagtgtggatccaaaaaccaatagcaacacctgagagctggttagaaatgtagaatttcaaggccaggcgcggtggctcacgcctgtaatcccagcattttgggaggccaaggcgggcagatcacttgaggtcaggagatcgagaccagcctggccaacatagtgaa[140 bp omitted]cactccagcctgggcgacagaacaagactccgtctcaaaaaaataaataaataaattccctccatacgtattcctaaatacatttttcccaataatgggctcgtaacaatatatcattaacatctttccattacaatgcttaaagagttacattattattttaattacttctattcaatgaatttcatttattttcaatagtctcttactgttgaatgtttaaaatgttcttatctaaaaatattgtcatgatcagaaaacattaaagctaatatttcacttatttaaaaagagtaaaaataattcattggttaaaaaaaaaagaagaagaaatgtagaatttcagggctgactgaatcaaaatctacttttttttttttgagacagagtctctctctgtcgcctgggctggagtaccgtggtgccatctcggctcactgcaacctctgcctcctgggttcaagcgattctcctgcctcagccccccgagtagctgggactacaggggtgcaccatgacacccagctgatttttgtatttttagtagagacggggtttcaccatgttggttggccaggatggtctcgatctcttgaccttgtgatccgcctgccttggcctcccacagtgcttcaattacaggtgtaagccaccgcgcccggccaaaatctacattttaacaagatccccagggaattaacttttgagaaagaaaactctaactgcaatattaaaacatttcctgggcgactatgtgagatgatggatatattacttaactccactgtagtaacatttttactatctatatgtatcccataatatcatgttgtatgcacataatgaaatttatttttttatttttattttttttcaagacagagtcttgctctgtcaccaggctggagt[141 bp omitted]ttcaccatgttggccaggctggtctcaaactcctgacctcgtgatctgcctgccttggcctcccaaagtgctgggattacaggcatgagccaccgtgcccggccataaaatttattttttttttaaaccaaacacacacgtactgagtgcttggtaggtgccaaaagctttaagtcagttcagtccccacaacactgatgtactatctttattattcccattttacagattagaaaactgaagctcagttcacacaggatggaggcttgaactcaggaccatgtgactccaaagctaaaacttgcaaagctaaaacttgcaatcattaacacctctctgcacataggagggacacttattagctgtctggcctagaggccttgggcccttcacccgcccccacccccactgaagcagggacttgttcttggtttcccaactacatctctgcccactcatgccccctcccaccccatccccacttctaagctgctacttttccttttttgttttgagacagggtctcactctgtcacccaggctggagtgcagtagcatgatcttggctcactgcagccccaacctcctaggctcaagggatcgtcccacctcagcctcccaagtagctgggactcctacaggtgcatgccaccacatccagctaatttttgtgtttttgtagagacaagttctcaccatgtggcccaggctggaacttttcctttcaaaaaaaggaaaacactctatgggtcctccttccccactcccaccctgtcctgccacccatcctaccctcaccccacccccaccatgccctgcagaaaagagaagagcttatgaggacacgttcaggctggagctcagaaaacccagagctaccaatgacttcaaagcagcaaacagcttgtccccaggggctctcagggatggaataggttaatccattacttttgtttcccctttttttgagaaggaagaagggcactctaggaaaagtcccacaaaaatccaagtctcaaggcatggtcaccctcctggctggtgaagccaccactccctccagctttgtgcctacgcctgcccagcacaccttccgtacccagatctccagagccagacagctcaaagtcatcagattcctgcccgggccccactacatcctcatcgtctggtagggctccggagaagtatcggccttctaggaggtcctgggggtcgatgacctcagtctctcggatctaagataaagaaaggagacacatcagccaacatccccagtgctccatgacagctgatgcccaaaagctagtgaagtgggcattcagaaactagaaagagaccaggccagggcctggagacctgcgtcctggatcccactctacctctaactcaccgcgtgtccttaggcaagtctctttccattctgggcaaataaaaatagtacatgaggctgggcacagtggctcacacctgtaatcccaacactttgggaggcggaggcaggcagatcacttgaggtcaggagttcaagaccagcctggccaacatggtgaaaccccgtctctactaaaaatacaaaaatcagctgggcgtggtggcttacgcctgtagtcccagctactcgggaggctgagacaggagaattgcttgaacccgggaggcggaggttgcaataagccaggatcacgccgttgcactctagcctgagctacagagtgggacccccgtctcaaaaaaaataaaaacagtaaatgaggtaataatcaaattattaatatggctagatatcctttaccgagcacttgctatgtgctgggccctgttttaataactctggaggcatgttattcacttctttttacagccgagggagtcattttcttttggtgacacagctggcagatggaagagcgaggattgcatacgcagggctgcctgacttcagagccaggagtctccatgcacagggccctgggatgctacactccagggctctgtgatgcagtggcagctgattcacacaggacagggagtgggctcctggttctggtcttgcccagtccaggatacttttcccagctgagtcagtctgggccgggacagacagggctgcctcacgcacaccctaagacagcctcaggtcagggcgctgcccagacctgatgactcaggagtgtactcctggattcagtcttgccttccaaacatctcccacagatctactctgctgccagcaccatgcagacaccgagaggcacaatccctaccctcacagaccatccactccagtacccataatcatcactcagccactaccctgtggagacacagctgatcaggacagagtctcaggtccactcccaccaaaccgcttgccaaaagaaagtgtcaaaggtcccgggcagccctacagtacatcagttaccctgctcccatcctgtagctccaccgagtgggaacaatgtaccctcaagagcacaggaaacatttggatgcccatcacccttcctccagcttctgggctcaggcttctgtttgcccagagaacagcagctctgagcaaagttcattattctactaattaattcaaacactaaagtgcctagtatttgccaggagagttggggtttttcattaagttcaatacaccatgcccctcccgctgaaagacattcccatcttctccagacgccataactgcaggagctgggggtctgcttagaatcacagaatgccaggacccaaggagctcctgtcctcccgtttcacacaacttgaatctgagcccggaacagggcagggacttgcccaaggtcacacagagcgttcgctacataactcaggatagaaagaggtcaggtctctgtttcggacaccccaggcagtccttcactcagctgagactgccattgacaaaggagggtgtctgagaaggaacatctgtccctaagataaggttattatcattgcaggagaggcccaggaaagctgcttcagagccactcctgtactctccccactgggcttctggggagaggcaggtggaacctgaccctcatgcaccctcttccacccccacagagggagaatgctggattcccggaagggagcggggtcaggccacaaggaaggcagtggccaggaatcactctctcccggggagtggggagaatgctgaacgcttggcacccgtgggggtggaaagccagagaggttaagtgctgctcagagatgacttcatgactcgggaatcaggagctgccgggctgctggtgctggaattcaagcccccgcacatagcccgtgcctgtggctttggtttggcagagcaggaggaaggctcctcatggctgcccaagtgcctatacctaagggcagggtccctgtgctcctacctccatctcctgtggcaaatcccccaagaacccaagtgacaggccttaaccaagcacacagcctgtctaggtccttttaatagtccctttttgcagagatggaaacaagggctcagaaaagtaaagtcacttgtccaaggccacacaagcaggaagtagccacactgggccagaacccaggcttcactgacctggacatttaaccacaaacacataaacacacgcatgaacacatatgtacacggggtcaccagcctgccccaggctccaagggagccctgttaagtaggggggtcaatctagccgggagaaagaaagaatggtacactttggccagctgttgaccaggtcaaagtcctcaacaggggctgtagttccatcaggagacttgtctcaggctgagagaccttttcccacccctcactgcccccaggagccatggaaggttgtttatgcatccagcctctctttcagtatgtgaaagtgctaagaggtatttcaaaacaacccatgggattagcatgcccactggctgttaggaattacctccgttttacattagagaaatgaaggctatgagcgaaagtggggcgtgaagatcttgcagccaagtcagcagcaaaaccaaggctgaaaccaagatttattcccagttcagccctctttgtgggcacctgttcatccttaacccttcatttttatactcagtttccaaaaaagaaactagtctagtctgaagtcaccccggggctccgcggcacggcctggattcgatcctatttcaaagctctgaaaagatggagtcttcaaaggctgcatttagatgagcccaggatttccctcctacagcaagtcaaggggctgggaagaaacttcttccagctcccagtggtgataggaggacacagggaattaaatctctccttgagctctggaagccccctctctgccctgttttggtcccttctccacccatgacctctgacaagagggaaggcaactccaaagtggataagagccatttaggactaggccagcaagacgggaccaagccccgtgggattgtgggcaatcactcttttttgtgtaaaggttgggaaggcaccaacggtcctcctctcctccgccctcttttcagataaagcccattgagtctggggtgactttgaagaaccaggccacccagcagccaggcccagccctgaccagagatggaccccgccctgctcctggctaagaatgtggtctgttctcctcagctcaccccacctttgcccaggcatgtgtgttcgtgtgtatacatgcacaggcaccctctctgggctctcaagtctccttgtatctttgtccctttcatgaacacacaacagaaattaccaactaagtaagacagtggtggctaggcacagtggcttaatcccaacattttgggaggccaaggtgggaggctcacttgagcccaagagtttgagatcagcctgggcaacatggtgaaaccccatctctacaaaaattagccaaatgtggttgtgcacgcctgtggtcccagctactcgggaggctgaagtgggaggatcacttgagcccaggaggtcgaggttgcagtgagctacgatcgtgccactgcactccagcctgggtgacagaggaagaccctgtctccaaaaaataaaaaatagggcaatgggcctaggtcccacagactctgctggccctgtggctggtggggatctgggattagtgcctgggggtttagagatactacattcttccccagactgttggggagaaagaagggaggggaagtgctcttttgttctacagaaactaacacctgccaacagaaggtatctgattttataacctagcaaacagacaagacaagggattttgccaaggtcatccaagcagctggcagcggagatggacttagaacctaggtatcctggctcccagactggaattatcttctctccccttccagggtgttggctgcccctaagggtctcagcaaatccacaggcagcagctgtcattacagttatactccccatctagtcttttggctataggcatgaagctacgaaaaggtcctatcccaaccctatccccaaatcctatggcttctatcaccccaggaaaagcatgagtgactaaaaggagtatccactacatgccaagcaccatgctgggtactttgtttatacaagttcatttaaatggcaaaacagccttgcaaggtgctctacccattttgcagatgagaagactgaggttcagctgagtcacttatccaacgtcatgcaactagaaagctagagctgggattcaaatccagatcttcctcaagaacacgtcccaaccacaactaggcttctcactgccacccactcttcacttctctccagcctaacccgccagtccacaacacactggctgggccagggctccagggcaaccctgtccctgcctaggagtaaacaaaggtgaaagtgatatcacttaaacaaaggaacagaaacttggctggggcaccagagaggagttcagggtcagggcttggataactgtgaactaatgagagcctctcccgacctggctcctccccaggggaggtagggtcggggacacacttgacccttctttcaggaggcaagaccagaagggtaataactgggcaagccaaatttagtggggagaggggatggtgagtacctggggctccaacacctggacccaccagaatgatttctagcaggagacccccagcagcgtacactactcgtaactgttcttccccaccccacccacttcttaagggccagacattccccagaatggctaaaacctggggcccacaactgtgactctaccacccagagtggttgtgcatcaaggcagattcacaagtgtgagttctgccacttcctaactatatgagcttgggagtttatttcatctctgaaatcctcagtttcctcttttgtgactagggctggtagcaccttgcagggtgatgaggattaagaggaatgcatttgtgtgtgcaagggacccagcacgtgatcaatgaatagtggctgtgattaacccctacctgccttcctcctggccagtgggatcagtgctcaaaggatcagaggcctgggaaaacttgcagaggcagttctgttgctggaaggaagctagcctggggacagggagatggtgctttgcaaactgtaaaggaatataatctataataggttatcattttgcttctgagcccagagacttttcaacaaccaatcaggtcccttcagactgtgaaaaaaagatacagagatagtcagagacctgcccaaggtcacacagctttgaccacctgtcctaagcagacagaggtaaagaccatttttattttccccgaaggtgcaaatgacagtgaccagaaacacctgaaattctacttggggacctgggtccccagggacaaaataaataaataaaaatctagaaggtaaaaagaaactacacaccaatccatggtctggtgctctggtgcctgaatggttaaaccaggtctgggggtgggggtggagtgagggttcaaatgtcgccttcaaggtcgggttactctgaacacaatcactcaggagagagccaggcctggcactgcctgcaaccagcttttcaccaagcctcagggcagcccattcccacagcaagaactccaggatcctagggtgccagctagaaatgggggaagggttcaggagcctctggatgtctccctgccaggagctgacccagcacccttgttactaactccctggatgatcgtggacaattcccttctctgagcctcagttttccaatctgtaaaagacaggtctcaaagagacaagcctccctctgtcccagcccagtaaccaagctgggcattgctccgattaccggtggagacagccaggagggggctggctccctcagggcctcagagacagaggtgcattgaagttggagcttgtaatctaggcagcagatccgaaatccctgctggatccgagggctagggaggctctcgggatgtaaacaaacctcctgtgttctcagagcagagtagagagcccacgctgcagccttatctcagctgattagatcagccctgggtgctggcttcctgcctcttcccagcctccctcaccgacccccaaggaagccatcctccagaccaggtcagtctgtcccacagacggctccggcagggcttctccaaggcaaggagtatccccactctgggtagccgggccagccatgtgccacatctgcccccacgcccagaggctagagtgacaccgccagtccccgcaggcctggccactgactgctgggcttcaccaagtcactgtttccacacataccagcctctccctgcctcccctttccattaccccaggtgtcacctgaccagcagcctcttctactgtgccagagaaaactggagcagccgagctcccgggcctggaggacagggggaggggtgagatgcagcctgaaggggtgggggccgctgaataggaaggtctgggctgaaggtgggggttgggggaagcaggaggcaagaacaaggctgggaagtgggggagggaggaaggatggctgtagaaaggtcaaagccagaaagaactgctgagatcagagtgaccttttggggagtactgcagccccctgaaaaggataaaaaggtctaaaccccaataactgtaactcttagtttacattttcaacatatgcacagacaccacctccccaaagccaaactctggccgggttaagaaccctcgtctaggtgctaataaagccagaactttacaagtttgccaaacagcgatgatgacctttgagtgccacaggtgttttatagaggacactggagttcacatcaacaaagtgacgtattaactgtgtgtgtccctgggtgagcagcagagctaggacgggggctggagttttctgtaccctctttttcagtcacccagccttcagcagatgggaccagagaggccccagtgagatgcaagaatgtgcccaaggtcaccactgtgttagttaatgacaaacaagcccaagaagtcaggcttattcttctaaggttaaatgagaccccaactgttgacatatgtgttctctctcctccctctctagggcaccatgcagtgaaaacatacgagaaactggcttttcagaacactgtaccttttctgtccaccaacaccccacccctcaaagtgctatttgcaatcactcagcctccttaagggtagaaactctgcccctccagcacaggagggtgaccccaggtcctggacagtgtccagagtggtctgatacccttggcaaaccccctgccccctctccctccaggctgcaaactgttcagcatgaggctccagcaaatcccagcaggagaggtggggctgcccagaactggttcttgtttaaacataaacccattcgataattagcaaacagcccacttctaagataaacaaataggagatttggactccaaaagccccaccctagatttctcccttcccacctcccagctgtgggggtagataagggggataagggggatggagaaagctttccaggagacctgggctcagaatcttcagagataggaccccctggcatgaaggtggcctgggcaaggaagggaactgtcactaagtaacacctcctccctaccaggcatggtactaggtgcctttatttacagccctgtcgtctcctttaagcttcgccacaccggtatcatgatcttcttaacagaccaggaggctggggctcagaggtggagtagcatgactgaattcatgtagccagtaagaggtggacttcgcacgtctggagttaagtctgtgtaacaccaagccaatgtttcaatgccctctggccagccccaggaagcaaagaggagtcctcacaaacatcagaaaatcctggggtcacaccaaacctgaacagtaccagcttttgctctctgaaaaaatgcaggccagttgcagcctcagttttgccttaaagaggaaaaaagtactacctgctctgcagaggtctaaagcccaattttgaggactggctgcacaatgtacaatgtcaaagtctacatgcaggcaaggggctgtgaaagtgcgggacctagtacaaacatgtcctgtatgtcccctcgagccccggacactgaaacagtgactcccaaaggacaaggtaaaactctgagctcattccaacacccccaccacagagctgtcctattagccaagagtttgaaaggaaatgggtgactcaggcaggctacgctagcatgcagtgactcacagcgctcggtccagccccttaccccaattttaagcattcatttggaaatcacactcgcctgtccagtccgggaggttgaaggacagctaggagccaacttctcccaacagggagatggggctgggagcccagcctggcttccccagctcctcattcaggcaggctcagcactccaagtccttggaaaagccctctgtttctaggagctggggatggcaggagctgaatgtccccccgccaccccaacttctcttctgagactgggatttgtttagactcttcaccaaggaggccagcaaagggcccctcccctcatcaatgggctctctgggcaggaaggacccttggaaggcaatggtccagcctccttattttagagttggggacactgagacccagagacagggcatgtttgctcaaggtcacccagcaacgcagaagtaggacctaaggtatctaccttcaaacccagcaaatttcctcatctggaatattctgaggacactcaaaccagacaccttgccctatcagaaggacctggttctgaccttaggaagccactgcattgttccgagcatcaatttcctgtaaaaatagagaaaatggtacctcgcagtactgggagatactcatactagcaataaataacagtaatgaaccatttagaataaagttacatgcacgaatttattcattcatacaagcatttcctgagtacaaactaggggacaggtatttcacaaaaacaaatagagcagagttcctgccctcagtgtgcggggggagagagggagggattcagcatttggtggagtatgttaattccctcaagttaattccttcaagagagagacctcttttgaatagtaggtacttaagttattaatcaaattgagagatggaaaggactctggaggctaccctgttcaaacctttcattttaaggtgggggatgtcagcccagcggggaaagaggcctccccccaacctcatggaaccctccaaatcatggcccaaatattttcgtgggtgtttgataactccctgggctcaagaagtcccaagagctctcactgttcactcaagggtcctagaagcccctaggcttccgcccccacccctactcccatgtaatcaagaagaggacgctgtagaagaccagaaatgtccttaagctaaagtacacttgataggtgataggtgggggacacttccccacaaccgcctgggcccggggccaagtcagtaggctgtgcccctgggtaggaacacctttgggtggaggggactcccaaaacaaggctgcctttaattggcctgagagggagtggcaggaaggcagatcagggaatgctcccagctggacaggaagaactggtttagtatagcaagcccagccaaacagaggagaggacagctgggtactgagcctgggttcccttccaaaatatgggggtggtaaggggaatgatggaacagtcgggggaacaccacccacaatgggagggctactagtcagagatcctggggtcctggatgccctctactaacccaaagtagtaccattttacctctcacatttgggaagtgggcataatagaatccccatgtgacaggtctttttgtgaggacaaaatgcaccagatctgtcatataaaaagtactctatcactcctaactgctattagcaaagtccttctccctgggcctcacttttctctacctgcaaaaagaaaaggacacgctggatcatctcttcagtccgagccaaccgtgactatgtctgatttttccaaccacaatctagaaaagagggaggggacaggccaaaggggaagccctgtgccccagttacaggcaggaggtctgtgacattagccaggaaggggagagctgaggtcaggatgagacttgacacctatctcaggaagcagctgcccagggctgatgtctcctgcagctgatgggtcacccaggcaggactgacacagtccccttcccccaaactacatccttcagaatgcccccaggacacagctgactgctcagcaccctgaagcacctgaaggctcagcagcccctgggaggaaactggcatgtgactgggcacacggtgacctcagcaacctcctgggtcctttcctctttttccctgtactgcctaggtggtatcccttcggatgcttccccagttgcttgacccgacacatccttcagggcctagtttagagcactgtgctagaggcagaaggcttgggtcctcagccactaacattttaggcaaggtagcctttggtttaggttaagtcatcacctcactctggccttgtttccttccacctcagaattcctttgccttccagcctaaaatctcaacctattctaaacccgtctttagttaccaacgatgggacacctggagtagcacaaagagtagaagttaagctaaagcagaaacttgaaagcctggctgcctaaatttcaatctgactcacccatttattgtgtattaactgtgtgaccctgggcaagttacttaacctctctagcctcaggaccagtttaagaacagtacacagtaagattgttgttggaattaagctcctggatatacccattagaaagttattagagcaatgtctggccccccgacaaaggcgctccacgtttgcaatcatcatggcatgcctggaattgtgctggaagtattgcctagggtctcattcattcctcaagaagagcctgcaggcagaatcaaccttccgctaagtaaattcagaggaacaggagccccaaggctttcaaagaaattaacattaatggttaaactgcaaggactcactcgctctgaaaactggggctaaagggcacaaagggggcacaaagctcaggctgtgggggacagattgccttcaccagtaattcccatgccccccaacttcccagatgagattgcccccctcctcctaagccggctgcgggcatggatagagcttctgctggcccagggacagctatgacggaggccagtggacagtgagaaggaaaggtttccctgggctgattgaggccttctctcccccctacccccttcacctcactcaaggtggatgcttcaattttcttatctgcaattgagaaaaaatgaacacacttcttgcagaaagcagaggctcagctcctggctaagtgttgagtctaaaccattcctctcctctgtcctcgaaaagagcagagtccccaactttctagaaaccctaacgcagtgtcccctcttgccccattccctcagacccttggtgcagtattgggaagagattcagaagggcaggactttgccctaagtcacaagtcaatgacagagctggggccagaactgaggttagggctcagttctccttggtgtgtgaaagagggcctcgcacaaccctaaaaccctcccccttccgagtacacgcagccccccgacccccagggccatctcggatcctaaagctgtctgctctgggcgccccgagagcgaggaggggattcagcgctccaagcctgccccagggtcaccagggaagggacgagggtgtgggagttgaagagttgacaccggcttagtcactaacgagcccgtagcccgcggcggggctgaggcccggggaggcgggaagagcaacaggcgaggggcgcacggcgcgtgaagccatcccggaggctggcccgtgaccccggagcaaagtttccaacaaagtttcccgggcctcggtgtccggttgggggtagcgtacccccgatctgcccccccccatcccacgctccgacgaacaaaggaggcaccggcctgcgcccccgcttcgcccccagcccgggaacctccaagcacccaccgactcggcgactccgcctacgaagaacagcagcagcgcgaacagacgggcgggggccatggcaccgcggactggagaaggcgcgcaggctgcggcgagtggccccgggcgggcgcgccacccatcttataggcggcctaccggccccgccccggcccgcccccgccccgccgcccgcaccccgcccggaattccccagtggaagcgaggcctgcggggcactgcgcccgcccgcggagttggaaaccccaagggacccgccctgcccgagcccgccggctcctactcaacccctagtcctaccctccgggaggtccaactccctttatttatttgacccactgccaggcaggtccccagagatcactgcggctaaccccattttatagttggggaaactaaggcccagggacgggaaggacttccctagggtgttgagtttagaccagccttcataccgggtgtgctcccctctgaagacacagaacttcccaaatgggatgtgaaccgtgttaagacaggggacagcaaactattctgtaaagggctaaatattttaggttttgcgggccatacgatccctgtggcaactattcaaactcgagcgtcgtagctcaaaagcagccataaatactaaaggaatgagggcagctaggtcctaataaaacattatttatagacaccgacatttgaatttaatataattttcatgtgtcacgaaatattattattcttttgactttattcccaaccatttaaacatgcaaaaatcggctgggctctatggctcacgcctgtaatcccagcactttgggaggccgaggaataggaggatcccttgagcccaggaattggagaccagcctgggcaaccataatgagacccccatctctacaaaaagtttttaaagaaattaaccaggcattgtggtgcacccctgtggcccagctactctggaggctgaggtgggaggactgcttgagccagagaggtgaaagttgcagtgagccatgatcgctcactgcactccagcctgggtgaccgagtgagaccctgtctcaaaaataaataaataaataaataaataaataaataaataaataaatgacattttataataaaaatgcaggccggatgcagtgagtcatgcctgtaatcccagcactttgggaggctgaggcggcggatcacttgagctcaggagtttgagaccagcctggccaacatgctgaaaccccgtctctacaaaatacaaaaattatccaggcatggttgcctgcgcctgtaatcccaactgctctggaggctgaggcaggagaatcgtttgaacccgaggggcggaggttgcagtgaactgagatctccccactgcactccagcctgggcaacagagcaaaactccgtctcaaaaaaataaaaaataaaaatgcaaaaaccattcttagcagtgggctgaacaaaaataggcggtgggcctcagccactctgagaccactctgacgctggtctcagagtggctgacgtctgttctaagggcttcatctaccagattttgaactttttcaaaagtttgatctctctgagaactggtctgcaagtttatttccattcttagggtaagcttccaccctttataagagaaagttgtgtgtcctccttacccttcatcctcctaacagtgcattggtgggagcaggttgagggaagaagtggaggggggtgctatatggagactgtaaaattctctgggtccccaagcacacgtactgttggaattattgcagggtgtgaaggtgggcattctacgatgatcgaagtacaaaagaagcctaaccctgtctctccctgacttatgtataaatctttctaagggtgtaacatagccttagaagtaggacattttggccactgttggcatattatgaattcatatactttgtggagtggagaattggtagtgacttccctttttccacctcttaattattatcaaagaataaaagtctcttgtggcagagaaccttggcagtaaagcaaacttcaaatgctgaccacggggtttccacagatttaaaggtaagcaatgactttcagtggtttttaacatgcttccctaggatttggaacaaaactgagaaaatgaagaaatctcatgccagaataagaaatccttttgcaagttaaatggtttgcaatctttgctttccacaaaattgcaggggggcctaatctagttgtcagtagatagatcattaaatatagaataggtaactgtgattttagttatctattgtcacactgttgtaacaagagttcttctgttcctaccaacttttataagtttctcagcacttacagccagtggtgtgccagtaaatgtttgacaattggctaggggaagtggcgagtgctaatttgccaatttctgtagtgtaaatactaccagcatggctgatttcaagctaccaatgagatgtcactgaacatggagctgggaagatatatttctaccacacagatacaataggtgcaaataatctcaaaagcatggataacagtaaagtgtagtgagataattagtaagtgatgagttttgagtatttatttcctttatggttttgtttttgtttttgtttttttgagacggagtctcaatttgtcacccaggctggagtgcggtgacgcaatctcggctcactgcaacctccgcctcccaagttcaagcgattctcctcagcctccagagtagctgggactacaggcacacaccaccatgcccggctaatttttgtattttcagtagagacagggtttcaccatgttggccaggatggtctcgatatcctgacctcgtgatctacccgcctcagcctctcaaagtgctgggattacaggtgtgagcaactgtacccggcctcctttttttttaatataattgtatgttcatataaattaatttttagtaatagttatgtttaacaactggctaatgacataaaaaaaaaagcaacaaaaaaaaaacaggatctctctctgtagcccaggctggagtgcagtggcaaaattatggctgattgcagcctcaacctcccaggctcacgagatcctcccacctcagcctcctgagtagttgggactagacatacgccaccacgcacagctaattattattattattgttattgttattattattattattattattattttggtagagacacagtcttactatgttgcccaggctgggtttgaaggcctgggctcaagcagtcctctcaacttagcttcccaaagtgctgggattacatggcacccagccacaaaatttctaaaaattgactttcatgaaccactacaagatggctttaccacaccatggtttgacagctataaaaaatgaaaaataggaataaaattattgctaaaacctgtttcattctagcaatattcgttgaggtgtttgtttgtttgtttgtttttgacaaagtctcactccatcacccaggctggagtgcagtggcacaacctctgctcactgcaaccttagcctcctgagttcaagtgattcttgtgcctcagcctcccaagtagctggaattacaggtgcacatcaccatgcctagctaattttagtatttttagtagagatggggtttcgccacattggccaggcttgtctcaaactcctgacttcaagtgacccgcgtgcctcggccttccaaagtgctggtattacaggcatgagcgactatacccaatctcatggaggttttagtgagctaattggagagaaaaattgccacagccacctaattaagacaggtatttctaaaacaactttactttttctacttaataattatttatcaaagtttgtaggactggtttagagagtgatgtgatttggatgtttgtcccctccaaatctcatgttgaaatgtgattcctaatgttggaggtggggcctggaggtgactggatcctggggcagatccctcatgaatagtttagcattatccacttggtgataaatgaattctcactctcagttcacgctggatctggttgtttaagagtctgggaactccaccttccctgtctcttggtcctgatgatgccatgtgagatgtctgctaccccattaccttccgccatgattggaagtttcctgagcccctcgccagaagcaaatgctggagccatgcttgtatagcctgcagaactgtaagccaattaaacctcttttctttataaattacccaatctcatatatttatagtaacgcaaacagcctaacacagcaagcatatatttatgtcaattgtatactttaaatatgtatagcttattttatgccagttgtaccttaatgaagctgtttaaattattgcaggactttttaaaagagtcatcagtaagcctctgacgcattaaaaaaaaacacattatgataaaattttgtggtggaacatggagtagaaatttgacttcaaatagaaaaagaaatgatgcaaaatgtctgactcttagaaaagagcttgttcatgtattttttaaatggatgattgtaggtatcgaattgctagggcatttaatttaactggatacatttaaaagagtgatgtaattgttttacttttacgtgtataaatttacaatatgccagaaattacaacctttgcaactatttaaacttttgatgaaaaatgttaagctatcaactaaaaattatgtcaaggagtacctagtcttaaaataatcatttacagagtacactagcaaaaaaacaaaaacaaaaactgaaaacagctcgtttagagagttaatggaagttcttctataaaactatcttaacctcctggaattaaggaaataatttccccttccccaagttctgagaatctctaaagggatgcaacatgtttgaatataattatttgtggatgtatgggtctttaacctgggctccatgactgggggcagaggacacatgcatggtcagtactcctctaggttatgtgtctctgcatacattattttggggcaagaaacttcagattctttctttatatccacaaaaagaggatgtttgggggatcctccttttgggtgatcctgacccccaaagagttaaaaataatttgtccaaaacctgagattctttgagaagttttattgggttcttctttggcctccaaaaaacaaaatgcagtagtcaaaggtttgtaatactgaataggagttcctaatttcctgcatggggctgaggtacaaaaacccaaacaaccaaacaaaacccacagtgtttacagccagaagttcttcattaaaatcctgtttccaggacttgccaactggaggaaagtttgtgagtccctttgctcctccctacaatggagataattccctcttgaactaattaggagaatggaataaggtgaagtggtgaacacataacatatactcacctatgttgggtccagcactctttctgtatattctaacctgagattgagtgagtctgagagatggcattggtcaaacactttacatcctccccctagcttcctttcaagcaaaaggaaatgatctaggacatcaacaggcagccccctcccatggagctaaaaaatgagctcagacccagcctatagcagaggtggtgtccctcccccttttctcagacttcctaggccggagttaaccaaggctaggtgcacacctggtacatccagagacaccttaaatgctaccttctcctggaatcctccatcctcttcttttaattctcatttcttcctgccttgaggtttctaggactctatctgtcccactctttgggcaggcatccctttctcactcatgttagttttaggtgaagagcacagtcttcaaagttaaagagacctagattgcaatcttggtggtatggagcaagacactttttctctctgtgcctcagttttctcatgtgtccccccatgtaatttgagggtcattatagttcttaacatcataaaaatgttaagactacagtgcttagcacaatacggagcatcaaagtgttatctatttttataatcaagggggcctccccataagagtcttgacttactcccctccccagcagctcctcacacatggttaataacaggtaacacattactattttcagaacagaaaaaggattgggccatagggctctcgcccaggatggtgccaaccctttctggtcttcctcagtttatgtaaatctctctccagctacagataatgacagcttagagtttccaggggctgtggaatgtccagccactgccttgcataaccacagaaactaagaacactaggcccagaagggtcctctcaaatcattcagtccaacagtacccgcattataagataggcaaaccgaggcccacacggtgaatcagcatccaccacaggcattttgaagaattctaaaaataacacctccaattactctttccacttgctttgctttatttttttgtcgtaacatttcccttacctgccatcacgcacttattcttttacttgtttattttctgttttctctgccacatgtaagtttcatgagggcaagaacattgttgtgttcacaactgcatcccttgcaccttgtccaaggtctggcagaggtttacattcagtaaatacttgtcgcatggataactggatgaatgccatttggacattttcccttagaggctcagatgtagcaattcactcacttggtcatttatccaaaaaacatctgatgaatatcttgtatgtgagaagctttttgataaatcctggtgaacaagacctgtccgtgttcttaagcagctccctgattagcggacaatagctgccagctatacagtagactgaggatctactatatgccaagctgtgggctggcaactttatatgcatcttctctgtcttagctcagttcttgcaattgcgaggaaacatgcctcactcaggactccttaagaaaaggcttaggagttattaggaggaccgggagggctaaaggttaaaactgaaagggaaacatcaaggactgagatgatgccacagactggctgactcatctcttgctctttaagcctgcttattctttctttaagagtgtctcttctttttcctggatgtgtgcctctctctcttttactgacttactggttctctcttctagtctaaattttgggaggggaccacaagactcattggcttggccaatggccttccttattccttaagtaagcgcctgcagcccagaccactttttggattactatttggcctagaggttgaacatttagcttctcacataccctgagcagagtgtatgtttaatcagaagggagtgttgagcatcatcttcacttggatgctgtgaagtaagtagttttatctctattttacagatgagaaaacaggcggagcaaggagaaatgacaacaaaaccgtaactgtaacaaagctgccctaacccacctgcaaatctacaattgagaaatccatttctgttgcccctgagatttgtggggtgtttgttaagtagcaaaagctgactgatacaagattcaaactcaagtttctttgattctgtctgcatcaccatgctgtctcactgaacttacagccctgattcctgttcctgattcccaagtgtcctgtcctaaaaggagcagagataaatattgtattcatccattttctgatgttataacagaatcccacactgttggtgttctgagtatactgacattccttgacgctagattttatattgttgattgacttgtttatcatctctctcctctatgagattagagtattttctctttattcactttattcatttatatccataccacctggatcagtttctggcacataataaatgctcaatgaatatttatcaagtagatgattgaatgaataaataatgataaaaaggaagtgtaaaaaaacaacttttcatcttaaaacaaggccctgagtcctttaaggtcagaataaagaataatttctaggtagggacagaaagtttagtacatgatggatggggtcaagaatcaaggtaagaaaacttgaaggtgtgaggctgggcacagtgtctcatgcctgtaaccccagccctctgggaggccatggcatgaggatcacgtgagcccagaagtttgagaccagcctgggcaacatagtgagattccttttctacataaaataaaataaaaatagccaggcctgatggtatgcacctgtagtcccagctactcaggaggttgaggtgggaagattgcttcagccccggagtgtgagcctgcagtgagatatgatagcgccactgcactccagcctgggtgacagagcaaggacctgtctctaaaataacaacaaaggccgggcacagtggcttacacctgtaatcccaacactttaggaggctgaggtgggcagatcacctgaggtcaggagttcgaaaccagcctgaccaacatggtgaaaccccgtctctactaaaaatacaaaattagccgggcatggtggcacatgcctgtaaatcctagctagtcaggaggctgaggtaggagaatcacttgaacccaggaggcggaggttgcagtgagccaagatcacaccgttacactctagactgagcaacaagagtgaaactccgtcttaaaaataaaataaaataaaacaacagtacaacaatgaaaataatacaaataaaaattaaaatatagtttcacaactatttacattgtattagatgtttagagatgacttaaagaatgtgggaagattgcatagactatatgcaaatactataccattttatataaaggatttgagcttctctgggttttcatatctgccaggagtcctggaaccaaccacccatggatgctgagggatggctgtactcagaggtccttccacccactgtcatgcctggcatcatccaccctgcatagatagagggtttgcagaaaacccctgatcattagacacagaacacagaaaaccagtttcctgactccctctggtgtgaaggaaagaacagggaggttggggtggaaagttagagtggaaagacagacaccccagatgtttcttaacttttgattattccagctgacaagacatgccacacctcaatgtgtactgagtgtgagtcacttccttctctaagcctcaatttccttacctgtaacatgtggacaatgtttatacctacatccctggggctgttgcaacaataagatgaggtcaggtagatgaaagctgtatgtcactgtaatgtccagtgcctttttttttttttgagacagagtctcactctgtcacccaggctggagt[141 bp omitted]ttctccatgttggccaggctggccgccaactcctgattgcaggtggatccacccacctcagcctcccaaagtgttggaattacaggcatgaaccaccttgcctggccttcagtgcgctttttgttacacactgagaaggaatagtgtgtggagtcaaactggcctgggttggagttcagctctaccactcactggcagcatggctctgggtaaatgtcccttctctgagcctcaggatctgcatgtgttcagtggggctattaatagttctcaactcacaggcttgttttagaaattaaataaggattaaattatataagtgcctgtcatacagtagatgctcagcaaatattcctccccaaacacagacacaaacagcacttaaagcaacctgggtaacaaaggggttttcggtctggaggagaaaccaggcagctaatgagctctctctccagttttccttctaagagaggaactcactggccagagcccaggatggtcaccgatgtagaggacaggcagccaactccaagcctcccacgtggggtttccaaaaacctgtgagcacagagttgcataacgtgtccctgagacacgtgtttctactgaagtgtcttcatcaaatattccctgaaaggaaacatgtgagcagggcagtagggcagcctagcgggggaggaagggagagggggaggaagggagagagggagggatctagagaacacgacagtaggggtgagaggaggaagagaaggtatcacatttaatgtgctcttactatgggccagccaccgggcttgacttgtctgatacattgttagatccttgccataaatctgagatcaggcatttccgttcccacattccagaggaagaaataataacaatcatattaacattgctgaggttaacatagtgcccactgcatatcaggcagtggactaagcacacatttgaccctcaggacagcccataacatgggtactattctgaactccactttatagaagaggaaaccaactgagactcagagacatgaagtaactttcccaaggtcacccagcaggacagcaagacagccagagagccaggattcgaatctaagcagggctctcaagcctatgggcctatgggagaacatttcccaagggatttatgggggtggatccagaaggtgaccttagcgattgtccttacatgcatgcagtggggccccagtgtgaaagtgacgaaagagaccaagtgaccagaggcactcccctcccctccacccaaaggacagtttgtcccagcttgtggcttttcgtcactctgcctctgacctgaagtttaacatttcattcataagtttggaaccacagacttggcagcgtaggaagaaccctcgtagaccagctagctattcaaatccaatcccctcatattacagatggaagaaaaccctgaagccggaatgtgactcgccaaggtcacagagcagttttctgttggatgaaggagccggtttagggtcaactacagatcatcttgtgctgtagttatcaaatgtgggtgcacctctgaatcacttggggagctctctaaatacacagatttccacactctgctttgggagacttgaactggacttaggtttgcaaacaaggactggaaatttgaatatccagtatgttcctcaggtgattcagatggcacagggccatgacagcatctgcaagtcggagtccaatgtccctctttcatttgatagtttgggatactgggacccaccaggggactcgcccaaggtcacatagcaagccagtggggctctagttcagactctgtggtctgaagcagactgcttgtggtcaaatttgaaaatgggccaatgaagctaaacaaaggggttgccatgattttccccagctcttggtttccttcttggatccaaattaagacggaggatgatgtacatttccgaagcttggcaaggcgggaatccaagaactgaactcccaaaggggaaaggaaagggcaggaggttagcttgcacgcccagtggggttttcccagaggtgagctccggactccagggatgacatcagacattccagccagccctaatatcaaaagctacctgtgttttctagttcagcagaatgggtaggcagggcctttcctattgggaggagatggggtggagtgggcccagctgtgacgtgaagggagcagagcccaggaagagccacgcattccagcatctgcaaggaagacagctgccctgggtattgtcaacctctgcagcccttttctaagcctttcctcccatttctccctaatccctcaccccagggctaactgagcagagagattcactgccccttttccacttcctgctactccaccacctattttactatctcccttcctttatttccctctccctccctcccttcctcccttctttcctgttcttttattctaaaatggcatcttggctggacacagcggcttatgcctgtaatcctaacactttgggaggccaaggtgggaggattgcttgagcccagggttcaggaccagcctggacaacatagggataccctgtctctacaaaaaaataaaattaaatgaaaaatcaaaaaagccaagtgcgggccaggcatggtgactcatgcctataatcccagcactttgggaggctgaggcgggcagatcacttgaggtcaggagtccagaccagcctggccacaatggtgaaatcccatctctactaaaaatacaaaaattagctgggcatggtggcacacacctgtaatcccagctactcaggaggctgaggcatgagaatcgctcgaacccgggaggcggaggttgcagtgagccaagatcatgccactgcaccccagcctgagcgacagagcaagactccgtttcaaaaaaagccaggtgtggtggcacatgcctgtggtctcagctattcgggaggccgaggcttgggcctgggagtttgagggtgcagtgagccatgattgcgccactgcaaaccagcatgggtgacagattgagaccctgtttcaaagaaccaaactaaaccaaaccaaaactaaactaaaagtcatcttgatgtttggagtcagttgtcctgaatttgaatctcagctctgctccctgtgagctctctgacctagagagtcacaccacctccccccaagcctagtttcctcccctataaaaaggggacaatagctatattttcagattgtgagaattaaacaagatcatgtaggcacttaagaaacagatgttttctcagaaacactagatcatgtgcataatcagtgaactagaggaatttgaatacatatttgttggactgaattgaggtgcctaaaagaatggttgagctggaaagcacctaagaaatctttgggccttaataactccccaactggagtccaggggaactgttcagggtatttccaaatgataaggacaatcgcacactctcaataaagtctcaagtttctttacttttgtctggaattgtatcagctcaaggtgataacacggctaccacaagctgttcagaaattctgattggcagttacatggctctttgatacgtttttttttttttttttttgagacggagtctcgctctgtcgcccaggctggactgcagtggcgcaatctcggctcactgcaagcttcgcctcccaggttcacgccattctcctgtctcagcctcccgagtagctgggactacatgcgcctgccaccaggcccggctaattttctgtatttttaatagagatggggtttcaccatgttagccaggatggtcttgaactcctgaccttgtgatctgcccgcctcagcctcccaaagtgctgggattacaggcatgagccactgtgcccagcctaagttttttttttaatgagaaaataattactggaaggtagattaaatggtggaaaacgttaatcatgtccaactcctcatttcataaacagggaagctgaggtttaaagaaggaagtggcttgctggtcacactgggtggcatagctggccctaaaacccaaattcttttcctggaacaacttacttcccgtctttccacttcagagagggggaacctaggatcaatgaagttgatgggttttcgtctgctggagtaggaataagtgagttatcgatttgctcttgctttttctgttcttaactcattcagcaaatatttactgactgtccactattcggatttggaagatagataaaacagtcatggcagcagagagggtcaggatttactcctatgtgcgacttcagaacctgtgcctttttccactggacacccacattttaaaacacccactactctgccttctaatatagttcatctgtgtctcagggcaggggctgtcttatatatacatgttctagccttcctgccaccgagtaggtgcgaaatcaatgttgtagtgttgaggaaacacttgaattttatttatttatttatttatttatttatttatttagagacggagttttgctcttgttgcccaggctggagtgcaatggcgtgatctcggctcactgcaacctctgcctcccgggttcaagcaattctcctggctcagcctcccgagtagctaggactacaggcgtgcgccaccacgccccgctaattttgtatttttagcagagacggggtttctccatgttggtcaggctggtctcgaaacaccgacctcaggtaatccgcccacctcagcctcccaaagtgctgggattacaggcgtgagccaccgcgcccgaccaacacttgaattttaatacttactttgctactaactgtgtcgttgaaacagtatgttgctttccttctctggcccttagcttaactatctgtacagcgggaacattggcaaactcctacgtggaggagcttgcaggtccacttcaagttatcagactctaactaggagaaaacattgagaatttaggctgaaaataacgacacagtttatcacctcgttaattcccaaacatcattaccgcgtcctaagccaccccacttgcctctcccctagccgccttcctttaaaaaaagaattcccctctagagggcgcgcaagctctgcggccttcgttcctctcttccgtttgccttcactcttccttctgcgcatgtgctcagttcgctatccggctgcttgtacctggttcaggaggttcaggcagaggttgcacccactacgcctgcgcaacctcagccccgcccctccgctgctttccccggaaacgtttctttcctacgcagccgctcctgccgccgtggtcgctggagctttgcctctctaggccggcagcgcctctcctccatggtcctgtctgtcagcgctgttttgggagcccgccggtgaggccgggccacgctcagacacttcgatcgtcgagtctgtcactggtgagtagaccccagaggagctcgtgtacgggcgggggccgcgcaggcggaatgggctggatttcccctcactctgagaatgggtctgtctgccccgccttccccctgactcttggaatgggctcaccccttggttccagtccctcctcccgggcggggcgacgttgccatggagacaggccgctggctgaggcccggctcgtgtccctgcagggcatggcgggtcagttccgcagctacgtgtgggacccgctgctgatcctgtcgcagatcgtcctcatgcagaccgtgtattacggctcgctgggcctgtggctggcgctggtggacgggctagtgcgaagcagcccctcgctggaccagatgttcgacgccgaggtagggtccccggactggggcgggtggggtctcggcctccccgagtaggctttgtggtccatcactactgtgctgtagacgtggctgggtcaccttctttctttgtagccctgggaaagggatttcacctttctgagcctcagctgcctcatccataaaatggaatgacagcagaggctgattagtacaaagaaaagggcctggatgttaatacaataaacacgtctgtgttccaggcaactctgatacatttcctttctgatactctgggaaagtgacttgatttctctgagctaggttctcaggtgccacatcggagagaggggtggataaaagagcattcgtgcgggtacagtggaaactgcctggactttggggtcagacaggcgtccgtttaagatccacttactagctgtgtgacctggggcaaatgtcacctctgtgaacttgttttcctgtcttcaaaaccatgagactagttgcagagaggtcgtggactgcaatataaagagcatgtgctttgggttcagaaaagcaagggttcagtctaggcctaaacatataaaactagctgtgggaccttgggcaagttgcttcccctttctgagccttttctgaaaagtgggccggatgctcctaccatgttgccctcaacaaaatgttacaaggcccagaggggtttaggaataagaaggtactttgtaaagtgtaaaggaggcctataagttgttacatctaagaggcagctgtggcgtggtgatgagcacagttcttttttttttttttttttttttttgagacggagtctccctctgtcgcccaggctggagtg[133 bp omitted]gacggggtttcaccgttttagccgggatggtctcgatctcctgacctcgtgatccgcctgcctcggcctcccaaagtgctgggattacaggcgtgagccaccgcgcccggccgagcacagttcttaaagccaggagacctgggatggagtccttgctcctgctgcttgttctctgtgttagcccttgggcaagttattatccaaaaagtgataagaattaaaagaagaagaatggctttgtgaggtttttttagggataatatgagattatgtatgtcaaagacctttctttgtcagctgaaagtgtggtgcagatgtttggcatttgatagtattgtgttggatagtggaggttgcacacccaccatatgcctagttgtagtctcgtaggagactctatgctcctgggaagagctgtgggaatgccaggctttgttgaagagccatatgatgcacacaacctgagttctagcctagggatcagcaaacctttcctttaagggtgaagtagtaaggattttaggtcacaattattcagctctgccattgtagcacagaaggctgctatagacaaatatataagtgaataggtgtggctgtgtttcaataaaaccttatgtacaggagcagatgccaggcctatggagccatagtcagctgaacgctgttctagactttactcttgttgtttattactttgggcaacttaacttgtctgagtttttacgtcctcctttgtaaaatgagaataatccctttccacctgctgtgagaaacaaatgaaatcccataatggatgtctatgaaagcacctattggaaataggctgccgtacagatgtagggaggtattatcttctgtgctctgggaagaatgcttgttccttaggaggcttgctgagatcctggggctctgccaagtcacttctccagtatatttccatttgtgattccccctcagatcctgggcttttccacccctccaggccggctctccatgatgtccttcatcctcaacgccctcacctggtgagtatcaccagttttgctatccagcttttgggctcttagtgctgggactaacttcctaagtttgaacatgagacaggctggcacttgtttctggggagtggtggagtaaagtgggtgacagaggccagttctgggaccagctgtataatgggcctccttccattgctgttttgacttacctggaaagctcttatgtcactatgtttgtgctgcctgcaagacaacttccatctcagataacttccctgatgtggagtgagctgagaaaggattcgaccgagaggcaggagaactgggttctgttcttggtttgtgtgccattggccaagttacttgccatgggcctcaggctcctcttttgtccatgagggtttggactcagtgatgtctaaggtcacacgtaatcattgcctgtctcttaagaggcagtttagcatagtggtcaaggtgtcaggctctggaggcagactcatttggcattgaacctcagctttactactagtctagtgactttggacaagttaatctaccacagttgcctcatcagtaaaatggggctagtaatattacctacctcatagttgtaaggattaaataagttaattcacaagaaggacttagaacagtgccttgcatgttattattattcttgtccttacaccggaggttgaaaactggtgggctgactttgacctaaatttgtcttccagataggttctatttggcttacatagatgtcagcccacacatggtgtttaaaacatttttttcacttagttgaaaatcaggctattttatataaaaatccagatttctggcttctcttgaataatggaatgactgactgattccaggccaaccttctagcatgataagatttgcctagatgcaagtagctactgcccccctttagctagaacatgtatgcttcagggtgtcatgatccccaccaattcctaggatcccctagtgacaattgccatcgatcatcaagctcatactcagtcagcttcactcttgacattacccgccaggttcttctaggcgtctggtatcataacccttgcttcacacttatctcgtcacttctgaccactatgctgccgtcctaattgtccctaccctcccaaataacctaaggccaggacaacccagtgacaactcactgctgtcctctccccacagtgccctgggcttgctgtacttcatccggcgaggaaagcagtgtctggatttcactgtcactgtccatttctttcacctcctgggctgctggttctacagctcccgtttcccctcggcgctgacctggtggctggtccaagccgtgtgcattgcactcatggctgtcatcggggagtacctgtgcatgcggacggagctcaaggagatacccctcaactcagcccctaaatccaatgtctagaatcaggccctttggacatcctgctgacacttgggccccttaacaccttgggctgctcagaccctccagatgaggtccagcccagatctgagaggaaccctggaaatgtgaagtctctgttggtttgggagagatagtgagggcctgtcaaagaaggcaggtagcagtcagcatgacagctgcaagaatgacctctgtctgttgaagccttggtatctgagaggtcaggaaggggacctctttgagggtaataacagaattggaaccatgccactcttgagccacaatacctgtcaccagcctgttgttttaagagagaaaaaaaatcaaggatatctgattggagcaaaccacttctttagtcatctgtcttacccccctgggacagctgttacctttgcagtgttgccgaatcacagcagttacctttgcagtgttgccgaatcacagcagttctgttggagaaacgcttggtttccggatccagagccacagaaagaaatgtaggtgtgaagtattaggctgctgtcagggagaggatggcagatggaggcatcaagcacaaggaaaatgcacaacctgtgccctgttatacacacgttcatgtgcacccaagaacctatgactttcttccagttccttctaccaggtccccatcctgctgccagctctcaacatagcaggccataggacccagagaagaatcccagcgttgctcaaagtctaaccatcataaagacactgcctgtcttctaggaatgaccaggcacccagctcccactggactccaattttttttcctgccttatttagaattctttggcgggaagggtatgatgggttcccagagacaagaagcccaaccttctggcctgggctgtgctgatagtgctgagggagataggaatttgctgctaagatttttctttggggtggagtttcctctgtgaggggcttgcagctatccttcctgtgtatacaaatacagtattttccatggttctgcctgcacttactttgtaatgccacggttgagattgagagagatcagcgcagccaggcaagggaactttaaagaattattaggccaccttctccctttcctggaccccagagtcattcctccatttggttaaaatactcagtgcagggaactcttacatcctgtctccttcacttgcagcgtcccctgctatgcctcaggtgaaccacataattcttgggtttccgttcctacttgctagtgatttctgaacatgttcaatggagcggcacacagtctagacccacttccgcattgaaaccttcactgttcctctttggtttcttcagagctttcccaagagagctgtcagttttcagctgtcagtaacacaaatgagtttatggtaacacaaatgagttttgctatctctctgagaagctcatctgacctcctgactctcagccctacagagtagggagttgatgctgacaggatgaagatttaggaataaatatgcctgggaagagactgggaaggttctagggtgaggcacctcagtaactcatggtaccttggccaagttggaaggaagcagtttgttaatgaggcacagtaatcctggctgcagggtctaggaggtaagaccagctgggatgaccttccctgggttaatcaatttccctctagacaacacaaactgcaggcatgtgactaactttgaaagaacacccatcatgtggctgctgtcacccttgaccagccgtggtggtggttactccatctgtggttggagcgcctctttgggattcacttcaaggtcttgtgcctatttttctgcatatcttctgtgatgacaaatctctgtcccctgagtgttaatttgatttttagaaatggccaaaagtcacgtgatccaaactttttttcagtaatatggagactgagctgcatggtagttggggatcaaaaatatgtgaccttaatgagatttttatgatttctaaagtaacaataaaagcagtttttagagttgagttccagagagggcagggcaatggcagtgacatgtttgtcattttaataataaataacatctattgagtgcttaagaggtgtccagcagtgtgggctgagtgctttatgtctcttttcaaaatcttcacaagaaccctctgaagtaagaagtaacgtcatctgtatcttacagatgagggagctgtaaggaacttacccaaggtgactttttaggagctggcagagccaggatttgggctctaatagtgatattaataagctcattttgaagaggtcagtagttagggatgtataagttctgactggctaaacagtctggttaaatagtttatcaccttataatcatatcttcttgtcctgtcaatttttttaaataccgaggatgaatagtactttataaacattactagctttctaagaaaagctgatatgcagtacattaaatatagccagagatttccttttttttttttttttttttttttgaggcagggtcttactctgtcacccaggctggagtgcactggtgtgatcttggctcatcatagcctcaacctcccaggctcaatgatcctcctgccgcagccccccaagtagctgggactataggcacatgccaccacgcccagctaatttttgtatttttatttttatttttatttttttagagacagggctttgccactttgcccaggctggtctcgaactcctgggctcaagagatccacctgcctcggcctcccaaagtgctgggattttacaggtgtgagccaccaagcccaactggccttttttttttttgaaacagagtttcactccgacttcattacccaggctggaatgcagtggcccaatctcagcttactgcaacctctgcttcctgggttcaagcaatgctcatacttcagcctcccaagtagctggaattacaggttggcaccatcatgcttggctaatttttgtatttttcatagagacggggtttcatcatgttggccaggctggtctcgaactcttggcctctcaagtgatccacccgcctcagcctcccaaagtgctgggattacaggcatgagccactgtgcccagcattggccagagattttcagatgatcttaggaatgtgggaaatctatttccaaaggataaaggaaggtacctagataagagagtactagcccactactgagttggcatatctcttaactctccaggtgtctgaagttgacctccctttttcccacccaccacctgaactctggccattcagagagaaaagtggagactcctacatagctgatggtcagaatagtttataacccttaaaggaggacaggaaaggaaaaagggatgtctggctcagagggtacttctaacccctcgctctaggcagccctgtccatatcagtgccaaatgagagccacgatggcagccagcagacatcagggggtacaatgggaagctccaggactcccagcatcctggagggtacacagctcaaacagtctcccctggacaggaatccccttggactccttcctcagcaactcccaggtcagagtagcttccttctgccagccccagaaggcagtcagtgcacaggtatgcaacacctccttgtaccggcagcccagggaccacggagtctcagaggtagggccctggggacctagggcagaggagtagggatggaatcaaggtacaagagaactcctctgtggagagattaaaaaccactgtcttaaggttttctgttgtaaagtaataaagggtggtagaaatagcattgaggcaggagggagtagagggagctgagggttttaatccctgccctgccgctacctgggcaagtcacagtcataggtccaattctggaaggctttagagagctgcagtggagtgcaaagtcctggagtcccattactagctgtgagatcttgggtaagctatgttacctcccttacctagatttcctcatatgtaaaatgagggtaataatggtacttatttccctgggttttgttttgtcttgttttgttttgttttctggtaggtcaacacttacttctttaaaatggaaaaagtgttccctccctggttttattgtgaagatgcaataagatgtcacgtgtaaagcgcctagcccagcccctggcacgtaggaagtgatccataattctagacaattattaggctaccgtcccccctatccattttacagaacagggacatttttcttctgagcctgtgttttcaaatgttgggggataggcttgccagtcctctaggtaccactaccaagtattgagctcctatctggcatgtactgcaaagtgatttatgtgtattcttactcagtccaataaggtaagcactactatttcccccattttgcagacaaagaaacagaggattgggagtaaacaactttttccccattacaaagttggtaagaagctaggcctgtctgcctcatctgcttttcacgttccagttatgtttatgtgtgatccagacaattgtgagacggacagtcttagggatctaaatgccatattagcaaaaggttgtgaatgtaaacgtacgtttggcttgttaacaagcagctagttccataaaggtgagtagttaggtagctgctgataagtgagaaatggagccgggactgactggccacagggctttattatgatggccgtggtgtggcgtgggaaaaggccaaacatttgttcaatgccccacaaactggcttctcctacatcaagcttgatttgcttaaacccccctgaaacagacattagtatcactattttataaacatgaaataggctcagagaggtcatgtgacttctaaaaagtcactcaatataaaatcagattcaaacacttcaattttttcccagttaactgttaagcagccatttctagggtggcctcctccccaaatctgtgttactgggcccagaggaggagctttaggttgaaatggttaaacaaagagagggtggtagtggggagaccctggttgtggaattgtgggaggcaggtggccagaggcctaagtgccggggcaggtgggatgaggtggaaggatgtactgctgggattccctcactcccagacctgccccttgctgccctggccatgctgggtccccgccttcgtatacagccctcccatatattcagtggcgttcccagtgggcaactggggcccaactccggctctctggagcaaagtggaagttgccagtctcactcaggcccaacccaatccagcctccacttggggctccctgggcaggcccccacgaaggctagtgcaagggagctccccagaaagggtcagattttttagctgggagggcgctgtcttgactgcccgctgacagcgcactcaggacagaagttcacgcaaaggttgatggaatggaagagtgagtagagattattttcgaaagttgatgggattgaaaatacccagcaagggaactgcaagggagactgttcaggaaatgggctggagtgcaagctgggtgggaagaccgctgaaagtggttactggggtggaatttgcacgggaattagcggggtggtgggggcggaggtaggcaccgaccgtaggggagctccaggaagattgcgctgggagcaggagctcgggagcacgcagcagccactatgaggtgctaagcagtccccgcgctgtggctccgcccaggctggtccgcgcggcagctgatgcccagtcttggtgcccagtaatggtggggaggagtgtgtgagtgggcggggtgggagggggggagagtccatccaatcgttctccctctgtcccaaactggagatctatctgcatcgctgccctgacccccaatcccggagagctctgtgcccctcgatggctccactgctctcccgagggcgcccactccatgcagcctgcctctggggaatatggaggtcttcgtccggagaaaactcgggctcccttggctttcctctccccaacggcatggttaggaccctgtgactcctaccgacagagggtgaccccggccagatggggtcgaccagggcttggggttgaggtcttcagattgagggtggacctgccatgtcaccctggagcagtagagatgcagtaccagctccccctcctgatccggtgccttctgtgatctgtgaccaaggcaggacacatttggaggcccagctgacatccactttttgacaccagccacagtgcaatcagtttttgacaatcaatttttgacaatcaggtcgcaatgcacgcgcatgacctacagggtgctggggctattccgcctgcctcgtgacttctgagcaggctctcatttcgccttttccctttcttgggaaaatggaatggggagcaaccaggagcccttgctcctgccactttctagctgagtgagcctgggcaagttacttgctgcctccgcgccgcggtttcctcttgcgagctcgcggggcgattgtgaggcactttgcacccaggaagcacacgagcgccctgacttcacagagcgcgccactcaggagactagctcgcggaggtgggggaggggtgctgctcgctggcttctttggttctagactgaccttaggggcctcggggtgggggtgggggaagcctgaagtcgcgacacaggctccctctaccgaaggcctctttccttcatccttcccagccccagacaaacaggcagagtaagcagtattcgtcttaggtgccatatggaagatcttatttgtagactcgtgaatttcgccacccattcctccccttcagctgatggcgcgatctccaccctctgctcgcacctctggctctcgtccaggtcacatcaacctgccagcagaaacctcggtgttaggcgctaagactgtccccagggggcgctggtcgtttggggagcgggcgcagggacaagggtgctgtggtgtctggtaggttggaaatgcctttgctaaaaaggaaaagcctccctttaagctagacccggtgggcactcacccccttcctttcgtgggactttcattctcccacgaaagggctgcggtattttcttctttttttgctaaggaactttctgctcagagtaaatctttttttcctttctttttttttaagacagggtcttgctctcttgcccaggctggagtgcagtggcgaagtcacagctcactgcagcctcgactcctgggcttaagcgatcctccgacctcagcctcctgagtagctgatactacaagcgcaaggcaccacatctggctaatttttaaattttttgtagagacagtgtctcattatgttgcccaggatggtcttgaactcctggcctcaagcagtcttcctgcctcgacctcccaaggtgctgggattacaggcgtgagccaccatgcctagcctgttcagagtaaatcttatttgaggcatgaatcaatcaaacataaatagagagttgaattgatcttagagggaatgggatgcagcaaagccctacttgaccatctcccccctcccacatttggaaatccttaaacccacttatgtaggcctctgactgtgagattcagagccacagcagtttccacctctgctaaggccttcaggcagtgagatggctcacttcagtgcccctccttccacacatctcctagctgtatcctgagacgcctcaacctagtcactacccttctgtatgatgttggtctaaggcttccccctctctggacatgaaggcggagcctcccagcactaccagccacacaccactcaagactccagatcctgaaccctgactctggggcccagctctgggcctggcttggggcttgcatctcacctagcctggcagtgttgttgtcacacccaccttgtatggatgccacataggcatttcaagtgatgcggagcagaagcgggtgcagcggcgcttgacccaacgcagggtggaggatctgcacatcaccctgggcgccgggaggtggattcgtgtgggcagcccctcaaaccagatccactggtcggctacatccagctgcttcatgtgccccatgggagttctattgcggtagggcttaatgaagatgactcgggggccctcggtgagtggttgcctcccctggactccagggttcaagctatcatccctcgatgtccttggaacctcaggctctatatgcttttctttccgtggcattgccgccaatgacgttttctccttgttcctcatccctgactgcacctgggacttccactccttgtactcttttttcttagggtcccctgtggactctaatttcttggacttgagttccttctcggagcacccgatctcctggaactcttcattattttgttttgttttattgcaggcactgttttccctggcagggagaggaaaggcagtcagcacagcaggaccgaggccctggttcccgagacagttgctatgtagccagctcaggggagcctgttaagaaaggctagaggggcctgcaaagaaacttctctactgcccagaggccttgtgctggtgtgaggaggtgtgatgagcactagcagagggatgtgagagattgggaaggtgaaagccatgactagtagttaaggcccctaagaatgaatattgtctacatcatctgccactagattagggttctgtctctctggacttcagctgggagggtgaacagtccagtagtttttctaaattgtgctccaagaaccttagggttctgaggaggtgtctcaatgtcacctcccctgacccactggggcaggatacctctccccagctcataacaacacaattggggcttggaaatagatatttgaacagaggtttcactgctttaataaagttggaaaactgttcaagaccagcctgggcaacatggtgagactctgtctccatacaaaaaaaaaatttttaagttggaaaatgatggggctagatgatcctgatccttctagctctatgtttcctgattgcctgcgactagaggccaaatcagaaagaggagcccagaaaggtggccttgacagaaatattaaatgctgagactttcccaaagggtgtctgtaacagactgggccccctgcaaacccccagtggcaacaccatcctagccaagggcgtggagagagatgaggccttgggctgcagataatggcaatactgtgatgataataatggctcccgctgattgagtcctcgctctatgccagactcgggacccttacaacttgggatccttactatttctgtgaagtagaaggcagtgaaacagagtggcttacagagcacaggtgttggattcagacaaacgggctcagattctgcttctgcctcttaccacctgtgtgatttgggcaagatatttaacctctcagagccttagcttccttatctgtaaaactaggataattctgtctacctaacaggattgttgtgaagaataaactaaatgggaaaattcttaagtgcttaacactgtaggatggtacttagcaggcaccaatcaatgttagctttcttaatactgtcatgtgacttatgaggaaacggtttgaacttgtctcggaggcatggtaaaaaaaaataaaaataaaaataaattaataaagaaaccaagcctcagcaagattaatcttcagatttcaggggtcagtctgcaggtgactctctgggttatattgacttgcaggggaggaggaggaggagtaacctgtctgtctcagtgccccagggtgaagtgagcaccacaactggatgattacaaccattgttatggccacagctctaatatcagacaggaatggcttcacatcctagctctgccacttatcagttgagttaactgaatgagacaagtcacttcacctcttcagcctcagctctccagcagtaaaatagagttaataaatacctctctcacagaggctttgtgaaaattagacttgttctctaaatgccttagcacaatgcctgttcccagaaagacggcatttgggtccattatgggggccaggccccagcttacccagaggagatgcggagaatctttggaacactgagcagtgaatgccaacaccttttggccagcttatgcagttcttggatccggcggtttgagctcttgagtagcttcaagagcgacaagttttttaacacctgccagggtcaagaaaccaggtaaatagaagcttcagctttcctggacagcctccctctcccctgcctgcctctggctccgctcagccaagggccggcctgctggctcccctgggccactcagcctggcaaccaggggcagtactgcatgagtatatgagcttccccaagctggggccaaaacagggcgtctcaccgttctcagacggttccgctcaattactttgctcacaggctgctctgtctcgtcccgcagtttctcatcttgcatctgagggacagaggataagagagacataaacccagaggaatcagccaggtgtggtgcctcatgtctgtaatcccagcactttgggaggccgaggtgggtggctcatttgaggtcaggagtttgagatgcctggccaacatggtgaaaccctgactctaccaaaaaaaaaaatacaaaaattagcgaggtgtggtggcatgcgcctgtagtcccagctactcaagagggtgaggcaggagaatcacttgaacccaggaggtgaaggctgcagtcagctgagatctcgccactgcactccagcctgggcgacagagtgaggcactggaggaatcctcctgaactcctccatgtgcctcttcatttggctgagcatggtttgaccaatcctaggctgggagttttgtcatcttggtctggggacagaactgggagaccattttaactctcctgacctcccttcacccttcaccttttccttttctcccatgctggaaagcccctttccttggcatggtggattctttgttaaggtcccctctagggactcacccccagggtctagtcccaagtctgaccttggaaaccctgctgttcttgggcctcttctttgctgatggactcatgctggggctgtgagacctcagagatgaatggagcaacaccagtgccaggcaccaaccctgttcctctcagttcagccagcactcaggctgggcatcagatggtggtgctggctctgtaccacctgcagctgtgacatcactgaaatgtgacagtagcagggctgggtctccaaggagtgtatgtggcagaggtgaggggtagagggtgagaaagaaatatagacaataggcgacagacagctgtgtgcattgtcacaacctccctgtggggtaagaggattatcccctctttttaaatgaggaagccagggttcaaagaggttgaataatctactcaaggccacactagatctagcccagctagatcatagtgggctggaaacctaaccaaggtctgatagtcaacccatgaaaccagggattcccaaaccatgctcatccattcagtcatgtcgcctgttttgactgggcgcctgctacatgccaggtgctttttcttttctttctctttttttgttttttgttttttgagacagagtctcactctgtcgccaggctggagtgcagtggtgagatcttggctccctgcaacctccgcctcctgggttcaagcgattttcctgcctcagcctcccaagtagctgagactacaggcacccgccaccacgtccggctaatttttgtatttttagtagagatggggtttcaccatgttagcaaggatggtctcgatctcttgactttgtgatccgcccacctccacctcccacagtgctgggattacaggcatgagtcagcgcgcctggccttgccaggtgctttttctaagtgctagaataacagaaaattcttgccctcaagcttacattctagtggaggggaaacagtgtgtgtacttgtaaatgtttaataattggctctctgaagcaaaatgtatatgtgtttgtattataaattttactgatagaaatcaacaaataatagaatcctataatactctttattgtaacttctattagtgagttgcttcttatagtatgcttttcttggattttgcctaacccctccatttatagccaacctatggttgtaatggataaacaagtataataccaacattaatgtttgtattttcatttacactaaacagtaagaagaaggtgaaaaagtgaaacaacagagatattgaaatttaactcatttatcaatgatttcattgacctatttgctgaattagaccatagtttttgaatactggagatatatttctcagattctttttgttatttacaatcgaatagctatgggcaggacacttgcttatgttttctctttttttgttgtttttggggggtcttttttcagatctacatatgattcatatatgatatatttctactctacagatatacagatataaagaatcctaagaacatagataatagtaaaaggtagtaaaaaatagaaagtgacaagtttaagcatttttcaccctatgtttttaatatcacttatttaattggaagttgctatcaattacattttaatgatggccgtgcctaacaaccagcctgcagaattcctagaagtgtaacagtagacttgtgagcccttatgagttagccccagcacgccaatgctacatcagatggaaataagtgcctggagaacagcaaccagggtaaagggaacagggagggcagaggtagagggtttggtatattaaaaaggtggtctaggaaagattcaccaataagatgagatttgagcagacacctgagagagagagggaagaggagaatgaatggtggtgggagaagatgaggcagagagggagtcgtggtgggttaggcagatcacaacaggctgtaaagggcgctggctgccctgaatccctggtgcccagctggctgcatcagaatagtatgaagagcttgtgaaaaacatttttgtgggcaccaccccattcagcaggccagtcagataaccaatcaaatgtgggacccactccacaccattccacttctagtggggagagatgtacatgcacggggggtgggtgcttagctctgaacggaggggtgaggggccaaccctacctaggctgtgggacagcttctcacatataaatatcctttcttattcaagtgaaggttaggtagtgggttaaactgctgctgtggcctaggaaagaaagcaatgtggtaatttggcaaggaagacacagagggtgcaccctctctctctcctgtctacccccatactccttggctgctctgcctgctcagacatacccctccttgcacacaatttcagctctgatcaactggacttcactgaacaatgctgctctgaggccctggtgcctggtgggctgtatcagaatcacctatactcactactcaactcctgagcttccagggctggggaatcactgtgtgctaggcactaagggacagcaacattataggcagagcatgcctctgagttcacaggccaaggggataggtaccccagaaggtagactcctcaagggcagggatttgtgtccgttttattcattgataagccaccagatcctagaacagtgcctggtggacaatgggtgcccaaaaagtattttttgaaaaatgaaataaatagcatgatacgggtaatactgagggttgtaggagcacagaggtggagcctcccaacccagcctgaggatgtcaggggatcttcctagagatggtgaggaggaatgaaggatgagtagatgttggccaagcatagcggtatggggcaggtcgagggaggtgggcagagcattctcaaaagagggaacttaaagaatatgagtgtggaatggaattatgttgtacattggatgttgctagattagaaagcagtagccaagagtggcaggggtgaaaactggagaagtgggtaaagagacctacccaatgacacacagctggtaagccttgtggactaaatccaagactcttgaatgaaaacctccactctttttttaaaaaaaaaatatggcataataagatatggataacacaaaatttaccttctaaccatttttgtttttgtttttgagatatagtttcactctgtcgcccaggctggagtgcagtggcgcaatcttggctcaccacaaccttcacctcctgcattcaagtgattctcgtgcctcagcctcaccagtagctgggactacaggcacacatcaccacgcccagctaatttttgtattattagtagagacagggtttcaccacgttggccaggctggtttcaaactcctgacctcaagtgatctgcccacctcggcctcccaaagtgctgggattatgggcatgagccatcgcactcagccctaaccatttaaaaaagtagttgggtgacattaagtaccttctctttgtacaaccatcatggatatccatctttaaactttttttatcctatggaattggatctctgtattccattaaataataactgcccatttttacctcccccagcccgtggcagccattgttctacttcctgtccctataaatttgactactctaggaacctcatataagtggactaatacaatatttgtcttttttttgtgactgccttatttcacttaacatgtcttccatgttgtagcatgtgtcagaatttccttctcttgtccgggcacggtggctcatgcctgtaatcctagcactttgggagaccgaggcaggtggatcacctgaggtcaggagttcgagaccagcctggccaacacggtgaagccc[136 bp omitted]caccccagcctgggcaaaagaacagcactctgtctcagaaaaaaaaaaaaagaatttctttttaaggctgaataatattccattgtatgtataggccacattttatttctctgttcattcatcgatggacatttgagtttcttctgcctgttagctattgtgaataatgctgctgtgaacaaagatatacaaacatctcttcaaggccttgctttcagcttttgtgtatatacctagaagtggaattgtggaactgccgaatcatatggtaattccctttttaatgttttgaggaaccaccatattgtttttcgcagtggctataccattttacatccccaccaaccatgtacaaggattccagtttccctatatccttgccaacacttggtattttctgtttctttgatagtagccatcttaatgggtgggagttccactcttttgttttatttcctctcatactttgttctttaatttctttagttaggtttactgggatatattttatatacagtaaaatttaccttttttagtatacagttctttaagttttgacaaatgcatactagtgtagaataccacagtcaatatatggaatggcttcataacccccctaagttccctcaagccacctctttgtagttaactcctcttcccactcccagccctggcaacaaactgatgtgtgttttcagtctttatagctttgccttttccaaaacaccatataggtggaatcatacggtatgcagccctttgaatctgtatttctttcacttaagatttgcacatgttgggtatgtcaataatttgggtttttttcattgttaggtagtatttcattctataaatatgccacagtttgtatgtgtaatcattaaaggacatctgggctagtttctggttttcagtgattatgaataaagttactaaatacatttgtgtacaggtttttgtgggaatacaagtttttatttcacttggatacatacttaggagtgggattactggatcatatggtaattatatgtttaactttaaaagatactgccagaattttccaaagtggctgtaccattttatatttccaccagcaatatattcaaggtctagctgactcacattcttggcagtatttggtactgttagatttttatttgtttgttttgtttttagccactctagtaggtatgtcatcatatcttatagtagtgttagtttgcatttccctaatgacgaataatgttgaacatattttcatgtatttatttgccatctgtcttttttgatgaagtttttgttcaagtcttttgcccatttttaggttgtttcttttaaatataattgtgttgagtgttcttcactaattcaggatctctttatcagatatatgacttgccagtattttccactagcctgtggtttatcttttcgttttcttaactatctatttaagaacagattcttaattttgatgaagtccaatcactttaatcacttttttttttttttttttgagatggagtcttgctctgtcacccaggctggagtgcagtggcgctctcttggctcactgccagctccatctcctgggttcatgccattctcctgcctcagcctcctgagtagctgggattacaggcgcccaccaccacacccagctaattttttgtatttttagtagagacggggtttcaccatgttagccaggatggtctcgatttcctgacctcgtgatccacctgccttggcctcccaaagtgctgggattacaggcatgagccaccacacctggccactatcactttttttaaatgggctatgcttttggtgtcatatctaagaaatatttgcctaacctgaagtcacagaggcttatgcctatattttcttttaaacattttatagttttagttttttaaatttagatatttgatctattttttagttaacttgtatatagtctaaggtgtggattaaggttcttcttttgcttatagatatccaattattccaacaggattttgttttgttttgttcagagacagagtctctctctgttgccca[149 bp omitted]cttcaccatgttacccggctggtctcgaactcctgacctcaagtgatctgcctgcctcagcctcccatcgtgtgagccaccatgcccagccccaacatgatttttttgaaaagactacctctctcctttgaattttaaaatcaacttactgatttctacataaaatcctactaggattttgattcacctttggattcattgttctgagtcattccttcctttttctgtgcatttgcagttgagtttttttctcaatctgcttcctgcctgtagaattttgggatgcaaaggcctctttttactttttaagattttttaaaaatttgaaatgattatagagtcaaagatgttgcaaaaatagaaaggtcctgtgtacctttctcccagtttcctccagaggtaacactggacaaagctagtacaatatcaaaagcataaaatgggcagtagtacaatatacaaaccgtgttcagattgtaccagttttacatgcactcatttgtgtgtttcatcaccataaggatctctcttgtgccatctatacctccctcctccattcagtacctaatccctggaaaccactaatttgttttttgtttttttgtttttgtttttgtttttgagatggagtctctctctgttgcccaggctggagtgcagtggcacaatctcggttcactgcaacctccgcctcccaggttcaagtgattctcctgcctcagccccctgagtagtggggactacaggcgtgtgccaccatgcctggctaatcttttgtatttttagtggaggtggggtttcaccatgttagccaggatggtcttgatctcccaacctcaggtgatccacccgcctcagcctcccaaagtgctgggattacaggtgtgagccaccgtgcccagcctgaaaccactaatttattatctactctataattgttgtcatttcaagaatagtatatgaataaaagcaagtgaaggtattaaaaatgttgtatgagtggaatcatacagtgtgtgaccttttgaagttggcttttttcactcagcataatgctcttgagatccaagttattgcatgtatcaatagtactttaaaaatcacagaaagtttcaaaaaatatacatagaggttttgtgtaccctttgctcattttcctccaatgggtgggaaaatcttacatacctttggtataatatcagaaccatgtataaattcaggtaaccaccatcacaatcaagtatagaactgttctgttatcccaaggcttcctcatgctattcatagctacagtcacccctccttcctctcaccccaatccctaaaagtcccacttcatctctataattttgtcattttgaaaatattatatacatggaatgatatagtatgtaacctttcaagattggcttttgtactggcttttccatataatgccctttatatccacttaagttgtatcagtagtttttccctttttttgctgagtgctattacatataacacagtttggccattcacccattgaagaatgtttgtttccaatttagggctattatgcaggtttttgtctccacacataattttcatttctctggaataaccttcaaggagtatgaatgctgccaaacaattttccagaacatcagcaatgttcatacattgatagaccttctctgcattttgacttgcttttagaatggtcactattttattttagctgttttaataggtgtgtaatgatatcttaccatagttttaatttacatttccctaatggctattgaagtttaatacattttaggccgggtgcagtggttcatgcctataatcccagcactttgggaggctgaggcgggtggatcacttgaagtcaggagttcgagaccagcctggccaacatggtga[132 bp omitted]atgcctctgcactctagcctgggcaacagagcaagactctgtctcaaaaacaaacaaacaaatgaacaaacattttaatatgcttatctgccatctctgtatcctctttggtgaaatatctgttcacttcctttgcccattttctaattagactgtttggatgtttgttctagaaaaagagtcttgctctgtcacccaggttagagtgcagtggcatgatcatagctcactgcagccttgaaatcctggacccaagtgatcctaccaagtagctaggactaccggcgcttgccaccatgcccagctaattttttttctttcaagacagggtcttgctgtgttgcccaggctgcttttgaattctcctggcctcaagccatcttcccacctcggcttccaaagcactgggcacaggtgtgagccactgtgcccaacctgtttgtctgtatttttacttttgagttttgaaagttctttatatattctagatatgagtcctgtgtaagatgtgtgatttgcaagtattttctttctaaatttgtatgtcttttatttccttttcttcccttattgtactagctaagacttccagcactacattgaatgaaagtggtgggaacagacattcttgccttatttttgatcttgagtggatatatgacacatatagtatatgtcactaacaatggaataccaaaatatatgaggcaaaaactggtagaactccaaggagaaatagacaaatcccattatagttgaagacttcaacgaccctctttcaataattgataaatcaagtaggcagaaaatcagtaagtacatattttatctgaataccaccatcaatcaacttgatctactggcatttatagagcactccatccaacaataatagaatatacattctaatacaataataatagaatacacattcatatctagctcacatggagtattcaagagatagtacattctgggccacgaaacacactggaacaaatgtaaaatgatagactcataaaaagtatgttctcaaaccacaatggaattaaactagaaacccataacagagagagctggaaagtccccaaggtatttctagaataaacaacacactagactagtaggtagcacatggatcaaaaaaaagtctcaagagaaacttaaaaatatttttaactaaattaaaatgaaaaatatagtttaccaaatttgtgggatgcagcaaaagccatgcttagaggaaaatttatagcattaaatgcatatattagagaagaagaaagatctaaagtcaatctaagcttcagaaagaagaaactagagaaataagagcaatttaagcttaaagtaagtagaaggaaataataaaaatcaaagcagaaatcaatgaaattgaaaaccagaagatgatagagaaaatcagtgaaaccaaaagctgtctctttgaattatcaataaaattaacagatctctagccaggttaaccaattttttttagaaaaagaaagatacaaattaccaatattagaaatttgtttgtttgtttgtttgtttttgagatggagtctcattctgttgcccaggctggagtgcagtggcgtgatcttggatcactgcaacctccgcctcctgagttcaagtgattctcctgcctcagcctcccgagtagctaggattacaggcacatgctaccacacccgtctaattttgtacttttagtagaggcggggtttcaccattttggccacgctggtctcgaacacctgacctcaggtgatccacccaccttggcctcctaaagtattgagattacaggtgtgagccactgcgtccagcccacatgtattatttagaaatgtggtgggatttttggattaatagaagtgtatttaagcaggaatacataaaatcgtcattgctagacttaatatgagatgttaaatgtttgatccaatttttcttcctggataagcttttctttcctatccctaccggatccgattccacatagagctactggatgagtatttgataatgggtctgaaattgggatagacatgtgctgatcttacacaagtccaacaaattaagccaagatgtttgatgagccctcgatgaatcatcattggttagggtcattgtgctgattaagtacccctgtttaaacccagatttatggccaaatgctcaggttgcagtttgtggaggtatgtcatattcagctggattgagggtcatgggcagaggggccaggtgtgatggagtatagtttgggagagtcatcttggtgacccagtgcacaactgcgcctcttgactcatgtattattcagaaatgaggtgtttaatttccatatgtttggagatttacctattatctttttgttattgatttctagtttgatttcattgtgatctcagaacacatgctgtgcgattttgattttcaaaaattccttgaggccgggagcagtggttcatgcctgtaatcccaagtctcttggatgccacggtaggaggatcacttgaggataggagttgaaggctgcagtaagccatgatcggcaccactgcactccggcctgggcaatagagcaagatgctgtctctttaaaaaaattttttttagttgacttttattctgtgacttaagatatagtcttggtgagtgttccataagcatttcaaaagaatgtgaatcttgttattgttatgtgaagtattgtctaaatattaattagattcttttgattgatggctttttaaagttcttatacatccttgctgctttcctgtctagtgtttctttttttttttttttgagacagagtcttgctctgtcgtccagggtggagtgcagtggcacaatctcggctcactgcagcctccgcctcccgggttcaagcaattctcctgccttagcctcccgagtagctgggattacaggcgcccgccaccacacccggctaatttttatatttagtagagacagggtttcaccatgttggccaggctggtcttgaactcctgaccttaggtgatccacccgccttggcctcccaaaatgttgggattacaggtgtgagccaccatgcccacccttctgtctagtatttctatcaagtgttgagagagatgtgttgaagtctccaactttaatagtagatgtctattttttttttcagttctaccaatttttgtttcatagatttttaagatctgttgtttggtatgtacacatgtatgattgctatgtcttctttgtgatttgacccatttaatatctttttttggccctggtgattttctttgctcagcagtctatttcatctgatattgaaattgctaactctgctttcttttaattaatctttgtatggtgtatcttttttcatccttttatgttcagtctacctatgtcatatttgaagtgagtttcttgtagagagcttattttgggtcatttttttcactccgttttgccagtctcagagttataaagtatatttatagactaccggcagttaatgcaattatttgttagggtttaagcctgccatttgattgttttcttttcattccctctgcttttcattcttctcttttatttctctactcttcctatgggttaaacagtttttagaattccattttttttatctatggtgaagtgttttttttaagtgtatctctttgtgtaggttttttagtggctgctttctatattacatcatacataacataatctatgaccatctactggtatcgacacttttgccactttgagtgagggatagaagcctgacctctatttaggtccctttacccttctcctttcataatgtaattgtcttaaatatcttcattacataaattgaatccacatcagaccatgttatataatttctgttttagccatcaaacataatttagaaaatgcaagtgaagaaggatagcccatcatatttacccatatttttattatttccattgttctttcttcactcctgatgtttcgggttttcttctttcatcatttcctttatgtttggagaacttcctttagccattctttcacggtacagcaggtcctcaaataatgttattttgtttaacgtcatttctttataatgttgatgagaaaaaaaaacaacaactgattcccagccatggccactgtctgtgtagagtttgcacattctcgtcatgtctgtgtgggttttctctgggcactccaatttcctcccacatcccagagatgtgcacattaggttaattggtgtatctaaattatctaaattatccaagtatgagtgaggggtgtgtgtgtgtgtgcgtgcacgcattctgtgatggaatggcatcctttccagggtgccttgcaccctgagctgccagaataagattcagccacccaggaccctgaaatggaataagcaggttggaaatgaagaataagtgaatacaaattattgtaaaataaaaatttgtaaagtatataataatcatacaaatgcataacagtaaataatttggtataagagcactcagccagcctgccatatttattattgtttttgaactgcatggtggtaggagatactccttacaatttttgctctgcaaagatttattccttggtttaactcaccaccatgatgactgctgtcactcactgcttatactaatccagcatgacctcactttaattacatcaccaataggtgagtaaataatgaacttccctgttttattaatctttcttaaatgtatgtatagctcacatttattttaatgtttaatactagatgtgtctgggcatttatttagaagcgtggtattgtttttgtgaccagaagtatgctgtatggacttaccttgttaatatcaattagtctacgataaacttgctttcattatacatcattttggttaaagttgcagtttccaagaaactattgatgacattaaggacttactatagttcttcagttaacaaattatgttagtttttccttcatttgagaatgtcttgactttcatacctgaaggattttttcactttgcttagcattctgggttgacggttttttctttcagtacttaaacatattgtgccacttctttctggctttcacagtttctgatgagaaatctgctgcaatttaaattgttgctgtattattggtaaggttaatttctctgcaactgctttcaagactttagttttcagaaatttgtttatggtgtgtcttgtatggatttctttggtttatcatgcttggggtttagtcagcttcttgaatccgtgtgtgtatgtctttcatcaaatttgggacactttcagctttatttctttgaacacatttttagctccaccttttttttttctcttcacctaggactcccatgacacaaatgttaaatcttttgttataatcttccatgttcctgaagctttgttctctctctctctctctcatctctagatcacctgatccagcaggtgatctgcccacgttggcctcccaaagtgctgggattataggcatgagccatcctgcctggctgaaatcctctttttatttgtactctttttatccctgcaaatctaaggtgatgtttttggatatataatcctttttaaaacttgtgggtcactttgaatcttattcaatattactctgttagacaaaagacatgcccacagatttctttgcaataagcccttctctactctaggcttcggctgagatggctaagagacaacaatcagccgtaagatttccagaatcactattgttttgatttggaggatctgtgagacatatccataatttgtttagactctttaaatatgactgaatagtattctgaggcactgccttaagtctttctgagatgttaacaaaatattttacattaatattcttttttttttttttttttttttttttttttgagacagggtcttgctctgtcgcccaggctggagtgcagtggtgcgatctcggctcactgcaacctccgcctcccagtttcaagtgattatcctgcctccgcagtagctggaattataggcatgtgccaccacgcccagctaattttttgtatttttagtagagatgggcttttaccatgttggccaggctgtacattaatattctcagtttcatatttggaccaggctttcctggcagtgccctgtatttgagttttgctaggaagccatttttaaattttactatcatctgctatttggagaggataagcattttctaaatcatgaagtcttagctctttcatgtttaacattctttccttttaaaaagttcagcgtttttcaactcgagccctattgatatttcagctaggataattatttgatgtgtgtgtgtttggtggggggattggggtggtttgaggggggctgccttatacattgtaggatgtttaacagcatccttggcctctgccaactagatggcagtagcaacctccccagctttgacatctaaaaatgcctccagacattgccaaatatcccttgggaggcagtgtcactctcactggagagctcttgctttagtttatccctttgctcctccctttcactataggcagcaagaagaaagcaggtggcgcctttaacattttgcttggaaattgctttacttagatcatcaaattcattaggcacattttctgttttccactttattgaaggcaacagggttgctaatttttgtgtcacagtatagtttccaataatatttacttcacttgtctgggtatggtggctcatgcctgtaatcccagcactttgggaggccgaggcaggtggatcacctgaggtcaggagttctggaccagtctaaacaa[141 bp omitted]aacactctgtcaaaaacaaaacaaaaaaacaacaaaaaaaaccccaaaaaacaaaaaaacagaaaaacagtatttacttcactttcctgcataccctcactgcaccttatctaagggccgaggcttctttaacagcttcttcaaggtgctttaggtttttactatactcttctcaaagtccaattctaatgccactcctgcatattagagtactgttacagcagtactttacccagtaccaaaatctttcttttcccctttaaaaatttttttctttatatgttccaatgaacagaattttaatatgttacctattgctgcataataaactatcccagaatttagcatcttaaaacaagaagtatttactatctcaaagtgcttgagtatcaggaatccaggagtggtttaactgagtggttctgcctaagtttcccatgaggtttcagtcaaactgctggccagggctgtaattatcccaagattttactagggcaattttatcaatttccatactcaatcatgtggttgctggcaggcctcagccttcatgggctcttggccggaagcttcctttccttgccatgcgggcctctctatagtggctgttgacaaaatggcagcttgcttctcccagagtgagtgaccccaaaaatagagtacacactaaagacagaagctgtagtctttttttttttaatttgaattttagaagtgacataccatcatttctggcatatcctgcgggtcacataggtaaactaatggtggcaggaggcagacaggttcctaggtgggaaggggtgggtccttggtgaaaccccaccttcaagccagggatgacctgaagcctgacagccaggcctccagttctgtgtggagtccactacctaaagtgagaacttccttgatgccttttggccaatcagatggtgctttttcctgacccggccagattcatggactcgttgggactacctgcctgcagataggagctacccactttgggtctcctctcctctgagagctgtttggtcagccgataaagctgttctctgccttgctcaccttccagttgtctgtgtaacctcattcttcacggatgctggtcaagaactcaggacctgccaaatgcgggagtaaaaggagctgtaacactttcctggccggctcgctgaggtgcaggtgggagctaaaggggctgtaacacgttcctggctagctcgctgaggtgcaggtggtgacacgttcctgaactgctggagtgaagagtggagacccttctggaggcccagacctcgggattctccgagccagagcggtaacacactagttctcctgccctctgccagcgccaggctgccaccccatgcaacaggaagcagtggcggggccaggccagcccaggagccacaggccggagcagggtggcaggactgaaagagcagtaacacaaatgggctgaaactccaccccctgaaatacagcacccccacctcgctgagcggctgccggtgatgagaaagagagaagagctgcagcccttctgggggcccagatctcggggctccctgaggcagggctgtgacatgctgtaacaccctctttggggctctgcagttcctggtgtctcagagctttcaggtgccactgcgttcccctggtccagacgctggtgcctatagcagaggtcgcttggggtaggtctggtccagccagagccttgcatggagctggtgcctgtgccagtgcctggagctgctcacgtggctgcggcagcttgtgtgcctggctctgtgtggtgactggacctcacgcttgctcacacacccccccaccactccatgcctggcttacccttggtaggcatgggatccgggctgcactagccaagcacagcctgccaggtgagtgggcagaacgagtgggcacaagcaaaactccagcagaggcaccaccagccacagaggttttgcactgaccaagtgacacccaaaggatcccgtgacataaccttggtacagtgtaggagaggactgcccggatgtacatgataggtggtaaggaacattgggaggtgttttgtggctgactgtggccacaaaaatttccattttattccatccaatatgtttttctttttttctttttccttttttttgttttagagtctcgctccgttgcccaggctggagtacaatggcgtgatctcggctcactgcaaactccgcctcccaagttcaagtgattctcctgcatcagcctcccaagtagctgggattacagatgcatgctaccatgtctggctgattttggtatttttagtagagacggggtttcaccatgttggccaggctggtctcgaacttctgacctcaagtgatccacccatctcagcctcccaaagtgttggaattacaggcatgagccactgcacctggctgtttcttcttctttcttttttcttcttctctcttcttttttcttcgtcttcctcctcctcttcttctttcttcttcttcttcttcgactgagtctcgctctatcacccaggctggaatgcagtggcatgatctaggctcactgcaacctccgcctcctggattcaagtgattcttgtgcctcagcctcccaagtagctgggattagaggcacccaccaccacgcccagctaatttttgtatttttagtagagacggggtttcaccatgttggccaggctggtcttgaactcctgacctcaagtgatccgcccgcctcggcctcccaaagtgctgagattacaggcgtgagccaccacacccggcctattttattatttttttgagatggggtttcactctgttacctgggctacagtgccgtggtgtgatctcggttcactgcagccttgacctcccaggctcaagcgattttcttgcctcagcctcatgagtagctgggactacaggcatgcaccaccatgcctggctaatttttgtatattttgtagagatgaagtttctgccaatgttgcccaggctggtctcaaacttgtgggctcaagcgatcctcccagctagtctcccaaaatgctgagactacaggcataagctcctgtgcctggttcaacactttttttttttttttttttttttttgagacagggtcttgctcagttgcccaggctggagtgcggtggtggcatctcagctcactgcaacctccacttcccaggatcaagttatcctcctacctcaggcctccaaatagctgggaatacaggcatgagccaccatgcccagctaatttttatattttttgtagagacgaggttttgtcatgttgcccaggctggtctcaaattcaaggtcaagcgatccacctgcctcagcctcccaaagtgctaggattacaggcctgagccagtgtacccagccatgtattttctaatatcccttggacttcatctttgactcatgttttattttgaagtattgggattgtttttcagttatctttctgttattatttctatttaattctgttatggtcatacaacataatttaaattcttctaaatttgttgaggattgtttttgttgcccagaatatgatgaatctctcattgaatgttgtatgtgcagttgaaaagaatgtttattctgctgttggtgggtaaagtgtcatgaatataattaggagaaattaatgatagtgttaaggttttctatatccttgcttttttggtgtacttattttattgattattgagagagaagggttgaattatctaggtgcaatatagattttttctgtttcttatttcaggtctactggtttttacttcatatatttttgaagctctgttgttagtatatacactcttatgactgttaagtcttcttggtgaattgaaccttttattattaaataataccacttttcctccctggtaatagtccttcttaaatctactttgtctgatattaatactgtcactccaacttgcttggtttcatgtttgtatggtgtgtcttactccattcattttttttttagggatccaattcctctacacatccttttacttttaacccatatatttctttatatttaaagtgggtcttgtggacaacatattattgcctcttactttgctcccaatctgctaatttgtcttttaattgattgtctttttactgatacactggattaaaatctatcaccttgttatttgttttctaatctttcatctgtgctttttttcttttttcttccttgatttggattatgtttcgaaaaggaaaactcccaatctcatgggtgctgcaagtagacaagatgtattgcatctgattgaaatagtttattattcatagcacaacaaacagtgtgaacatcagcatagttgtattggttcccctggtcctacattcaacagatgatgcagtgagcccagatgcatggtattcacacagtgggtttgcattgtagctgagggacctaggcccagcactttttattttattttattttattaattaattaatttatttgagacagggtctcactgtgttgcttaggctgctctcgaattcctggactcaagtgatcctcctgcctcagcctctcaaagtgctgggattacaagcatgagccaccacgcctggtcccaggacatttttatagcaagcagtaagcaagcctgccttggtctgagaaatgatctcacctctcaaaactctagctgtactaacaatcctgaacaaggacccaggtgaaagagaggtctgggccttgtgatcttgacatactcagcaagacacgttggacacaagtggcctagggaggaagcctcccaacattagaaaaaattattatatgtacttgttttcatgttcaacagtcattttaaaaaataaattttattgtatatgtttaaggtatacaacatgatgttatggaatacatagatatagtaaagtgattactatagtgaagcaaacgaacatatccatcatctcacatagttacctattccagcatttttatgattccattttctattattggcttgttacttacacctctctaaaaaaatttttttagtggttgctattgaatttactatatctttaatcagtctatcttcaaataatgttataccacttcttatatatcataaggaccctttaacagcatatttcccattcctccatctcctcatttttactgttgttattgtcatacatttcacttttatatatgctatgaggccacaatgcattgctttagtaaagcagttaccttttaaagtgagtaaaaatgagaaacaatgtctcttatatttacctttattctatctgtttccagagatcatcatttctttatgtagatccaagtttctctcaggtatcatatttcttctgcttacagaacgtccactggtaatgaattttctctctctctttttttttttttgatctgaaaaagtgtatttccttcatgtttgaaagatgtatttgctaggtatagaattctggattggcagttttttgtctttcagcattttaaagatatgactctattatcttctggttatataatttctgatgagaagtcttctgtaattctttgttcctctgtagggagtgtgcctttttcctctagatgccttcaatattttctctttatctttggttttcagcaatttgaatatgatatattaggttgtgtttgcatgtgcttctttgttgtgtttgtatattggcatttaatcttttctggattctgtgagtttcttggctctgtggtttgatatctttcattatttttggaaaattattagctattatatctacaaataaatattgtatctacatatatatatttttttttctctgtttcttctccttctgggatatgaatcacttatatgttagcgcttggatatttgttctggtttttgtttgtttgtttcactcttttctttttctgtttcaatttgagtattctctattgacctatcttcaagttcactggttatttcctcagctatgtcgagtttactgattgatatagtttggttgtgtcaccacccaaatctcatcttgaattgtggttcccataatccccacgtgtcatgggagagaccaggtggagataattgaatcatgagggtggttcccccatcctgttctcatgatagtgagttagttctcacaagatctgatggttttataaggggcttcctccttccccaggcacttctccttgctgctgccacatgaagaaggacgtgtttgcttccccttccaccatgattgtaagtttcctgaggcctcctcagccctttggaacagtgagtcaattaaacctcttttctttgtaaactacccagtctcaggtatgtgcttatagcagtgtgagaacagactaatacagtaaactggtattggtagaatgaggtgcagctataaagatacctgataatgtggaagcagctttggaactgggtagcagatagaggttagaacagtttggagggctcagaagaagaaggaaaatgtgggaaaatgtggaacttcctaaagtcttagagggctcagaagacaggaaaatgtgagaaggtttggaacttcctagagactgttgaatggctttgaccaaaatgctaatagtgatatgaacaatgaaatctaggatgaggtggtctcagatggaaatgaggaactagctgggaactggagtaaacttcacttttgcaatgcaaagagactggtggcattttacccctgccctagagatctgtagaactttgaacttgagagagatgatttagggtatctggcaggagaaatttctaagtggcatagcattcaagaggaagcagagaataaacttttggaaaatttgcagcctgatgatgtgatagaaaagaaaaacccatttttttctgggagaaattcaagccccttacagaaatttgcataagtaacaaggagacaaatattaatcaccaagacaatggggaaaatgtctccagggcatatcagagacctacacagcagcccctcccatcataggcccagaggcctaggagggaaaaatgatttcctgggccaggtccagtgctcccttgctgtatgctgcctcaggacttggtgccctgcatcccagccactcaagccatggcaaaaaggggccaaggacagctcgggctattgcttcagagggtgcaagccccaagccttggcagcttccatgaggtattgggccagcaggtgtgcagaatgcaagaattgaggtttgggaacctccgcctagatttcagaggttgtatggaaatgcgtggatgtccaggcagaagtctgctgcaggggcggagccctcatggagaacctctgctagggcagtgcggaagggaaatgtggggtcagatcctacacacagagtccccactggggcattgcttatggagctgtgagaagagggccactgtcctccagacccccgaatggtagatccaccaacaacttgcactgagtgtctggaaaagttgcagacactcaatggcagccatgaaagcagcagggagggggtctctaccctgcaaagccacaggggtggagctgcccagggctgtgggagcccacctcttgcatcagtgtgacctggatatgagacctggaatcaaaggatattattttggagctttcaggtttaatgactgtcctattggatttcagacttgcatggggcctgtagcccctttgtttgggccaatttaccccttcaatttctcctatttagaatgagggtatttacccaatgcctataaccccattatatctaggaagtaattaacttgcttttgattttacaggctcttaggtggaagggacttgccttgtctcagaagagtctttggacttggacttttgggttaatactggaatgagttaagactttggaggactgttggaagcacataattgtgttttgaattgtgaggacatgagatttgggaggggctggggcaaaattatatggtttgactgtgtccccacccaaatctcatcttgaattgtggttcccataatccccacatgtcatggaaaggaccaggtgaagacagttgaatcatgggggtggtttcccccatccttttcttgtgatagtgagttacttctcatgagatctgatggttttataaggggcttcccccttcgctgggcacttcttgctgctgccatgcgaagaaggacgtgtttgcttccccttctgccatgattgtaagtttcctaaggcctccccagccctgtggaactgtgagttaattaaacatctctcatttataaattacccagtctcaggtgtgtctttgtagtagcgtgagaaaggactagtatactgataagcctgtcaacagcattcttcaaatctgttatatgtatgtgttttttcttatttctagcatttctctatgtctctttttttgtagtcttcatatttctgcaaaaattccccttttgttctttcatattgtctacattttccacaagagcctttcatattcacgtattacttatagttgtcttaagttctgtgtcagataattacagcatctgcatcttgcacctggtcttgctttctctctctctctctttctctttctctctttctctctttaatatagaaacagggccttacgatattgcccagactggtcttcagactcctggcctcaagcattccatctgccttggcattccaaagtgctggattataggtataagccaccacacctggactgctttgtctcttgacagtaggtttttttggtattttaaaagttgtgtgtgtgtgtgtgcgttgtaatttttgtttgtttgtttttgagatagagtttcacttttgccaaccagactggagtgcaatggtgcgatcttggctcactgcaacctctgcttcccaggttcaagcgattctcctgcctgagcctcccaaatagctgggattgcaggcacccaccaccatgcccagctaatttttgtattttcagtaaagatgggatttcactgtgttggccaggctggtcttgaactcctgacatcaggtgatccatccaccttggcctcccaaagtgttgagattagaggcgtgagccactgcacccagcctgtgttgtaattttttattgaattttggacacagtgcttataatagtaaggactgagttcattattatttatgcctggaaattgtcgtatctcttcttctcttaggccattagtgtgggggattcagtcagttttttcaggagttgaattaggtttgagttttgttgtttctatgattacttcagtgtctatatctcctacaaattttatgtagtcatgctagctatattgggtctttagtaattccataaaaattttggcctggcatgttggcttacacccataatcccagcactttgagaggctggagcaggaggatcacttgaggccaggagtttgagaccagcttagacaacatagcaagaccctatctctaacaaaaaataataataataataaaataaaattagccatgtgtggtgatgtgcatttgtagtcctagatacttgggagactgaagtgggaggataccttgagcttagtgagtcatgactgcactactgtgcttcagcctctggacagtgtgagaccttgtctctgaaaaataaaaacataaacattagctgaactcttctaacctacttgtaaggagagcttgtctttctcttgctacacaactgagtgagtgcctgcatcccgtcacttcctggaggctcctgtccttctttggaatgctggttaattggttgctctgcaaccttaggtctctgataagtttgacaaaagttgtgattttgtaaattacccaacaatttttaaaaactgttattagtttgataatgatgctcttcccaggtttctgcatcctagatggaagccggagtctcaagccgtctaccttttcacggtgctattcaacgttttggccacctactcctggcctgctgcttgggtctttcttttgggtgacacccttccagtttagccccctgaaatattttcaggttagatgtttccccctctccattccttctttatggcaaatatctgacaaagagaagggacagaggttcctgatctttcttcatcttgggctcaaaataatccatggagtcgtgttctgaaggatacatctgggccaggcgcagtggctcacgcctataatcccagcactttgggaggctgaggtgggcagatcacttgaggccaggagttcaagaccagcctggccaacagggcaaaaacccccctctaccaaaaatagaaaaattagccaggcatagtggagtgcacctgtaattccagctactcaggaggctgaggtgggagaattgcttgaatccaggaggtggaggttgcagtgagctgagatggtgccactgcactccagcctgggcaacagagcaagactctgtcaaaaaaaaaaagggatacatctctgaaaatggggacatgactgggagtgagctaagctcttatccactgtactcctgacttggccctcattttctgtgctagaaaattagatgaagtatctactctatccattaatgagaaataagaatcaaaccaacccaatgaaatagttcttagaagatgaaaactacaacaggataaaaggggaacaggcacaggataaaagggttgtaagcacagtctctagaggcagtctacctgggcttaaattccaggtccatcacttactagctgtagggcctgggacaagttccttcacctctctgtatctcaacttctgtatctgtaaagtggaaacagcaagaggattaaaagggttaatttttgtaaagcacttataatagtgactggcacataataagctctgtggaagtgttaacaattagggcttacttcctataatttcagaaatttgtggaagacagcagttccctccctttctcagaacccattaccatcaaaacagctaacgattactgagcatttccaaagtgcccaagtcctgtaactaaccattttatataaattatcttataagagggagggattaattattcctctttagtaggtaagagatcaaggatcagagaagtgtttacccagctggctagaggaatcaataggtttacaacccaagagggtctgactgtattgcctgtgctcttaaccattgcatttgttgcctcccacaaactagtttccatgcttgtaaactagtgggaaaattgcatgctgtatttatctcacagggttgttttgagatcccaataatgttaagaggcagtgctttagtgtacagagtgctggtcccctgacagggaaacctgaatgtgtcaatgatttgttcacacttccctccctctgcacatgcccttctccctcttttctgcttgttgaactcatgtcttcaagacttagctcagatatcagcgtccagattttattctaacagtggaggaatttaggcaacgccgcgtggcgggggggtcgaggggggcacaccagacttgtgttctgaaatgacagctgacttgtaatgcagggaatggagtgtagccgggccagaatgagtacaagaaaaccagatagggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggtgcggtggcgggcgcctgtagtcccagctactcgggaggctgaggcaggagaatggcgtgaacccaggaagcggagcttgcagtgagccgagattgcgccattgcagtccgcagtccggcctgggcaacagagcgagactccgtctcaaaaaaaaaaaaaaaaagaaaagaaaaccagatagaaggttactgcattaggagcccaggcgggaggtggtggggcaaacggaaggaatggtggactggaaagatatttaggaaagagaatcgacaggaaatggaggtgtattttaatataggcagcgagggagagggaggtggcaaggatgactcctagttcctgacttgctcgcggatgtttgtcgaatgaatgatccagtgaccccaaggcagaagtatctcagagagatccccccactcccctccccgcacccgtcaccacgctgccttcggagctctgaccgtaagggggtggatggaaggcaggaggaagggaatggccacggagtcttggtccaggagctgctagactggacacttctagcactggtctgagccaggagacgctgcgaaaagagggcaaacgtttctcctctcgcagttgccgcctcgcccctccacccccgcctggccagcagcgcagcgcccctcttagcaccgtggaggtgctggctccttgccggcgtcggggggcgcggcgtagcggcccacccttccagctctgacccgcccggccggcccggcgcccaccccgcccagtgtgcttggtaggttgggcggcggctctgtctagtcccagagccaggaatcaggggcagccgggcgagtcccagggcaggggtcctccgccgccttgcacctgccctgctgggcggcaccgggtcagtgccctgccccctcctgcgggtcccaactctctctttcccatcgtgcgtcctctggagaagtgcgcgcgtgtaagtgtggcgagtgtggccaagggtgccggaggcagggttcgggtgcgtagtcgttgcgtgggcgctgcccaaaaggcgcagagcatcaagtgtgcgtgggcagaaccggcgcgggcgcccgccgcgggtctgcgcggggcgggggcgcagcaagtgcatccgagcgagcggagactagcgcaccggcgtcggtggcgagggtggtgcagaggagtccggctgggcggagggaggaaggatgggtgcgggtaactttttgaccgccttggaagtaccagtagccgcgctcgcaggggctgcctccgaccgccgggcgagctgcgagcgagtgagcccgccaccgcccctcccccacttccgcctcccgcctcttcctcgttcccggctcccagggcccgtcggtcccccgggagccctggaggcgcagccccaccccggccggcgcggctcgctcccacgcccccgccgcggcctcgctggagcggacggactgagtcagagggggcgccagcgctgcaggtaggggctccggcggcggtgggcgcaggtgccgcggtggaccgcggaggggaccggagcacgaggggaacggccttgggggagcgccctccccccgtcctccgccgacgcctcgtgtccctttttagggaattttttccctcttgctggctccagtgcgggtggggctgagaccgagagggagttctccatttcgctggctcctgcccggcccctggcagcctcctgcccccaaatctcttcaccccctttccagtacctataggtcgcgtaaacaactccctttctccagctctgggctccgcggccccccgggggacagctccttcagtctcgtgagatcggtggggttagggggaggggaaaagagagggggtgtcccagagcccctggcccccgtcagctcccccaccttggcctctccctccccctcctcgctgctggagcacaggctccaggggccctgggtatttttagcgttgtgacctgggcggcagctctaagagcctttcccgggaatcggcgtcagcgcctcgctcctccgccgccagcccgcggccgcacggtctccccagacttccgtggccctgccttggccagtcggggttgggtccctctccacctctgtggcgcccgtggagctggccagggtctgggatacgctgggtgcagatgaggtggggaaggcagtctgcggaggatgacgtctgatcctcaagctagaaactcccttgcctctggtgatgggctcagagcagaacgccgggaaggagatgagcgaatgggaatgaatgcaccgacctgggctggcccatagcctcagtgctctggcagggtctcagcttctcagccctaggggtcaggaggcctgctctgaactggacccagaacccgcctttccaattgctcctcactgactaatggggagataagtcagtgagatgtgtcccaggagggggacgcataaagagctgttggagttcaaaggaaagatggtagtctcctaaatagctcaccttcacaagcagggtcttgtatttgaggcaggtaggttggttatgccattttcagatggggagactaagaccagaaaggtgatttccttaggggcagagcctagtctggaagtcaggcctgtgacttcagagcaagggtttggggtagatggcacatgcgtgtgtacgtgtttgtgtgggtggagagaaaaggaggggcgcgggaggagttgctttagcctttgtctgggttttgaaggatgggaaggggtgggctgcagcactggaggaagggaaccctccaccctgagatctctgtctctatcctatcctgtccctggccttctgaggcaagcggggccaattaaggggaaaacgtacctcctccatttgtgctgaaccaatccctccaacccctctcaggagggcatgatatggagagttgggcattggctgtgttccctgaatacagagtatctctcttgtggtgcctggaactggcatcccctttgtggagcttagggcaagccccgcctctgcatgagacttggtttgtgggacacacttggtttcagggaaggggaaagaggtcaccaagggcagaggtgtccaggccggagccaggggccccactgttgggatgctggctgcagtggggcgccccaagcccaggtcccctctgtcttctctttcgactttgcagctgtacttgttttgctcctctacccgcaggagctgacatggacccaaatcctcgggccgccctggagcgccagcagctccgccttcgggagcggcaaaaattcttcgaggacattttacagccagagacagagtttgtctttcctctgtcccatctgcatctcgagtcgcagagacgtaagtcccaagtcctgagaagagggactggggtagggtagggaggatgtcctgtgggtcctgaatcttgtggcactctctcccctctggttttcttggccctctatgcttctaacttgggacctgacatgtaactctcactgtcctggtgtgcagcttgggtcctcctgacttgcccacttcttgatccgcagcccccataggtagtatctcatccatggaagtgaatgtggacacactggagcaagtagaacttattgaccttggggacccggatgcagcagatgtgttcttgccttgcgaagatcctccaccaaccccccagtcgtctggtatgcccctctgctttggggacttcagtgccagtcagccagagccggatgtcaggctctgaaacgaggctacaaggctgggctggggaagtacacaagtaagggctggaagtgggtgtttctaccaatgaaacagctgcctgttctgattttagggaagttgaccctgagggagaactgggttacacatctctaatccaaaattctgggaacggtcaatctcttctttaattttacatttgttatattaatataattagtcactataattaaaataatgtaaaattgtaatttttatatttggcaacttaagtagttttagtcattataatgatattaatatgtattgagtactttagtaggttccaatactgtactaaagtactttacatatattatctcaatccttacaacgtcctgtcagggtaggtgatataatctctattttataagcaggaaattaggctcagagaagttaagtcacattgtagccagaaggtagataaactggaattcatgtctgtctgactccaaagcccatatgcttaacttgtaagatagatattcttttaattaaaactgctactatttattgatggcttactatgccagacattttataagcattcttaggttttattcccaaaaccctttggggatgtaggtatcccttttattttgcagaggaggaacagagtccttgaaagggaaagtgacttgctcaaagccactcagcagcaataagtgatgtaggtggaacttgaactcttgccattcattgacctgactgtagatcccagacatggtgtaatgacgtggaaggagctggcagtcaggagatggtgatcttaatcctggctctttgctggattggcaaagtcactttggacaagtctctgccccactgtggactttagttactcctggccagataatctttaagagttctctgaagccctgtttgtggcctgaccagcttttctctctgggcagggatggacaaccatttggaggagctgagcctgccggtgcctacatcagacaggaccacatctaggacctcctcctcctcctcctccgactcctccaccaacctgcatagcccaaatccaagtgatgatggagcagatacgcccttggcacagtcggatgaagaggaggaaaggggtgatggaggggcagagcctggagcctgcagctagcagtgggcccctgcctacagactgaccacgctggctattctccacatgagaccacaggcccagccagagcctgtcgggagaagaccagactctttacttgcagtaggcaccagaggtgggaaggatggtgggattgtgtacctttctaagaattaaccctctcctgctttactgctaattttttcctgctgcaaccctcccaccagtttttggcttactcctgagatatgatttgcaaatgaggagagagaagatgaggttggacaagatgccactgcttttcttagcactcttccctcccctaaaccatcccgtagtcttctaatacagtctctcagacaagtgtctctagatggatgtgaactccttaactcatcaagtaaggtggtactcaagccatgctgcctccttacatcctttttggaacagagcacggtataaataataaactaataataatatgccaaccattcgacttcatttttcatattgcaaagatatcaaacccactacatgtctttagctctctaaccgatcccatattcctatcactcactcattccatttattcaagaaatgtttatggaacacccatgctaggcatctggaatacagttttgagcaagacaggctgtactgtatacctgccttcatagagtttactgtttatggaggagaaaatcaagtaaatactacaattcacagtgtaataaatagcatgatgaggaactactctggtaccagaaaataggggcatgttaacctagtttctatggtcactgaagagctgtttttagctgaaggacgattgggagttagccaggcacagtccgtaagccaggcagaacgagcagctcgtgaagactttaaacggagagagcatatccttgaggagctaaaaaacattgcgtttggctgaattgttggatttgaggaaatgaagggagagttaagactgacaaaggtcaggttgtaaaatccgttgaagcctggatcaggtttcagtttgacagctagtaaaagatcatgacttaagatataaagttatttcctcatatagaagttaaaaagtacaggtctacatgaaagctccatcgttactcagcactgggctccttttttgctcttttgcacatggtttgcattcttagcaatatctcacatctaaggtggctgtcaaagccccagccatcatgaccttgagactggcagaaagcaggagaggaaatgggggatgggcaaagagggcacagccagtctattcccatttaggaagaaatttttggaagttctttttttttcccccaagatgaagtcacactctttcgcccaggctggagtgcaatggcacgatctcggcacactgcaacctccgcctcccaggttcaagcaattctcacatctcagcctcccgagtagctgggactacaggcgcacaccaccatgccaggctaatttttgtatttttagtagagacgggatttcaccatattggtcaagctagtctcgaactcctgacctcaggtgatccacccaccttggcctcccgaagtgctggaattacaggcgtgagccactgcacctggccaaccatcctatagtcttccagcagagtctctcaaatcagtgtctccagatagacgtgaactccttggcatgtcaagtgagggggtactccagccattctggctccttacatcctttttggaacagagggctagtcacccagatggggagtttcagaaaggaccaggtttgagaagaaggccataaatttggtttgggacatgttgagtttgagatgtctttgagacatccaagaggatatgttgagtaggcccttgcacccatgcatgtggaatttagataagaggattgagctggaaaaagaaaacgatcagttctcagtgtataggtggtaagtgaagccatgggtgcgaatgacaggagagaatgcccagggagagaatgctgaatgaaagaagaggttataggacccagtcttaaggaacatcaactcatttctcacattcaaaaaaaaaaaaaaaaaatcagtccacctcccttcatacattgaacatcacccatgggatcagtgaccttcagccaaaatcctaaagctttttgtgccacccaaggttgagtgacaaggctgcagtcttcctattgtcccatcctgctctcacccctgcaggaggccagtgtaagtatctgttcctaagtgtttttcctaacactagtgagaaacctgtgggaactccagggaagtaggagtgtccaccagccattccctgtctctaggaagcttgtggagtgaataccttctgtgcaaaagcctctaggtccaagttgagatcatccactgagctgggccagggcccagtcctctattaacttttggggtttttctgggttgcttatgaccttgctgcacatagaagacataatctctgtcctcttgtggcttctctccttccttcctttagagtagcaaggttctatctacctcctgtctgactgtggctgagccatctcttgggctgcggcccatgatcccaatagctttgctgtgcagggcttctcagctcccaggatcaccccccttccttccatggtgaacgatgagaagctagactggcttggttgccgtcaacatgtcaataaatctcttagtagcccaggcacatgatgcgaagattgtggggagcctgccttgagagagggatttacagccctctagagaagtagaattgtttctgagcctatggggagccttcagtttggctgctatgagccccagccctgcctggaaaagtctagtgtcagctgagaccccaggactacttcctagttgggacaataaccttttctcctgccgaaccacaggggcttggctggccttcagaaccatcatctccagctgactgttttttgtttctttgtttttttaaaaaaacttatgggggtttcaaacgtacaacaaatatagaaagaaaaatatcccaggttctcatcatacagcttaaaaaatcatcaaaatagtaccaagattgtatcatctacccaccacatatttttagtggaaagacatttatgataactcttgaaagaaagagtagactataaaacaccatattcaatatggtcactttttaaaaaaatgataatcttcagattcaccatttgattatagtgttgcattaaagttaaaccgtggtttatggcagcccagagcctagctgtctggtttttgaggccacacagtgcctttggaggtgggaggaagatctggagccaactctaagtcaaggagcccagctttcagtctccaagctacagcgtggcttctgatatttgcacggacttgtcatagggtggacatcctgacacacttcggaaaggaggcaccacagctcagaaaaagtttccttagaaggcttacactgtagcaaccccaggagtgcacagaacttgacactgaacagcatggcagagtagggaaaatacagaactgtgctatgatgtcatcttgtttgttcattcattcacacattactgagcacctactatgtgacagtcaccttgcttaggcaacagaaatactaaggtgaccatgagctcttccaggagcagacacagacacaggtaatggaaacaatgtgatgagagatgtagcagaagtacatgaagcctgtagaccactagaggaggagaaggtaagtcttcactagaggtggctgggtcctgaatgatggagatgggcaatttcaaaaggaaaacagagaagtacaaaatagtcataatgatggcagctacctttaaaaaagtattattttgaggtttgatagtgtagactatagtcctagctccatcactcattgtaatctttattatcttagtttatgtacttcttaataataacactcaagcaaccctatcacttaggcactattatctacatttacatattagtgcctaggtgacagggttgagtgttactattaagcacttgctacattccatatcctacatgtacataatttctcatcttaacaacaaccttgaaagtaggtttcttcattatacaaatgaagaaaagtgacacttgggttgatcatgctcatatggattaaaggctggcatagggatttggactcctgtctttctgacatctaagcccatggccttcctaatatttcgtgtctaatggggcaggaacactgaatgcaggcagaatgaaggcataatgagataaagacatctttctgacatttcctttctggaaatgtctggttggttggcgcatatcttggcagacctgcctgacaccaaattggctctttctagaagtgtggtcatgagtgtcaccaagagactgttcatgaaatccttcatgaatgtgtttcccatagggcaggtggaaaaactaaagcatgactttaactttggaactccgaaaaagtcaataaaaagacaagccagtaaacaaaggggtgagggtgcagaagactttaacagacctttcacaaaaaaataaaaattaaattaaaaaataaatggcaaataagcacatgaacagatgcttaacatttttagttaccagggaaatgcaaattaaaaccacaatgagcaaacactacatacatacccaagtggtcaaaactaaaaagtacaaaaaattagaaacttcaaatgctgaccaggatgtggtacaatggagactcatagtttatggaaacataaaatgatacattttggagaaaggtctgacagtttcttataaaattaaacatacacctgctctctgacccagcaattccactcttaaatacctggccaaaggatatgagaaatatacgtctacaaaggagcttgcacagacagcagccttgttaataataaccaaaaactttaaaagtgcccatcaagagttgaatggataaattaataatactacgcagtaataaaaagaattgtggatacatgcaagaacatggatgattctcaaaaacattcttcccatgagaaaaaaaaaagccttacacagtatacatactatatgatttcatttatatttagttctggaacagattaatctattgtgggaaaaaatcagggtactaactgcctctggaaggtgatagaggagcagggattgactaggaaagggtattgctaattttctggggttttaggaatgttctgtatcatgataggagttcgggttacataggtgtgtgcatttgtcaaaactcagtgaatgtgtactttggatttgtgcatttcactgtatgtgaattttacatcaaaatgcaatcgaatactgaactctagttaattatatgcatgcttaactacttaaaggaaagtgtactaatgtctgcaatttactttgaagtgcaccaaaacacaagatggaatgatggatgtatagacaaatatgtggtaaagtacaagtatagtataatgtaaatagtagaatctaggtggtggaaaataggtttattgtaacaggtgctcattctttcaattttgtttgaacattttcgtaataaaagaaccacttatttgggggttttgcagcaaatggagacactagaagctaagaggggcaggaggttcctcttactttgggaaatgcaaattaaaaccacaatggttttcccaaaagtaattgatctttttcagtcaatgtttcctcaactatcaaatgggtaaaatggcagtgaaggagcttcatattattaagcatttcctggtgggtggaatacgccatgaactaggtgcggcctcaagctggttactcgccctgcctactccctctcgtgtcctcccagtacccccttagacccaccagctctgagggaatcttcgcgacctgcgcaggcggtcgctctgataaccgcatcccggtttccgggacgacagcggaagtcacttctcacacgcctttcttattggataccggcttttcatggggccgagcgccgctgggtaggcggaagtagccgcaggcatggcggcggctatgccgcttgctctgctcgtcctgttgctcctggggcccggcggctggtgccttgcagaacccccacgcgacagcctgcgggaggaacttgtcatcaccccgctgccttccggggacgtagccgccacattccagttccgcacgcgctgggattcggagcttcagcgggaaggaggtgagggcgcgagatctgaccagggaaagatttccgtagtgcctgctggctggccggccgtgggatgaaggcaaactttgggggcggggcctaattcctgggtagagttcgggatcctgggtgtggaccccgacgaggtggggatcgtcactcacctgctcccgtttccccagtgtcccattacaggctctttcccaaagccctggggcagctgatctccaagtattctctacgggagctgcacctgtcattcacacaaggcttttggaggacccgatactgggggccacccttcctgcaggccccatcaggtgcagagctgtgggtctggttccaagacactgtcactgagtgagtgcacaccttgggccctgttgcaggccatggagggaatgtggctgggagagtgttgtcatcctgccactgctcttggggacagcacttccagtaggcagcgattccatgggggtagagctggcattggaagtaagaaatgttaccacagatgaataaacttcccaatcctaaaactttcagacctgaggtagcacatgcatatccctggagaggcaaatagcaaacaattaatgcttatttggaggtaaggcagtagaaaactggcaactggataaccttttaaaaggcattcattaatattttttaaatgataataaataccacgaaagccaaccataacatatctgtgggttacaactggccaacaggatgctacatcacagtgttagaggaactgcttttgtttgggagggggcaggtctagttactgtgcctactacaaaccgctatttcccagtggctgctgtggctatcctgtttagaatagaacctttctgtgcagtggttgcaaacaggtctacatgggccacacaggtaaggaatgaataaaggtatttttaaaattgacaaacacaggaatgagaaatatatctcattttcctcttaatcccactataagaaatcaatagtgcaagtatgatataacaagttttagggcaataaaaaggagcagcaggaattgtggcaggctagagagtttgtgtgacattctaacgaggacagctctgccactcagcttctatggattgttgccatgtgggaatagaggcctaatgtggtcagagtcaaatgtttctaaaaattttttgtagaaacaaggtctcactatattgcccaggctggtctcgaactcctgggttcaagcgatcctcctgcctcagcctcccaaagtgttgggattacaggcaagagccaccacacctggcctcatttttcaagagataccagaaatctggaatttaatgtgaaaattggcaaattcaaatatcagcaagtaatttaaaaattttttgagtgctgtgcgggtcaatgttgtgcataccaaatgaagcatgtttatggtttgagtagagctttccggcttcaagtttgccatttttatttgaggcttaaggattggagcagttgaaaagctctgaacatagaattatcaaaagctcctggacaacactaaggaataaggaataagcagtaactccccagcttgccaagactttctctcttgcctcaactctggctcccctaccctttcctgtctactctgctgtcactgtcttccctcagcccgtaattgcctgaaatgtggagcaaatgcttagaattctttctagtgcttattaagttttatgctttctctattactgagagcaaatctcttttgatatttctccaagaaaagaacattaatttaatttgatgtttttatgaaatcctagaacagttgtttttcccatgttcagtgagcttttttggatataagacttctcaccatgatagtagaatcaggacttacctttattcccagagtatacacagggtagtatgcattgttttgcccagcccagcacattcaaggaagatcagtgagctcatttcagctctgatacatgaggcgctttccatggtgtcaggggaagtacatagatgacccagactggtccttgtcctcaagttgcttacagcctagttagggagaaaaggtggtcaggacacgatgctgctgccacctagccatctcccaggagggacctagtaagatgcttggatggtcagaaccgtgactgcacagaggagactgtgcttaaggagggcaggaaaggcttcgtggaggggaggtaagcactggagccggatcatgaaggtaggcagaaagaagttagcaaaggcttgcaaggaaggaagaatcacctgagcagagacccatggggatgcagagatgtccagaggagagtgaggaagaaggggctgagtaggatgagacccagcaagtgggctggctgggggcagcaatgttccagctccatcaactggcccgtctaatagttaagaatacagcctcctcctatcataggtttagcagccagctgtggactttgaaagagggagcagaggtagccccaggacagtgagtggatttgtgtctctatccagtgtggataaatcttggaaggagctcagtaatgtcctctcagggatcttctgcgcctctctcaacttcatcgactccaccaacacagtcactcccactgcctccttcaaacccctgggtctggccaatggtgagataacccctacagccctttccttcttcctcttacctcctgcccaaacctttgcctccttttccctcagtttcctgcttcctcagcctgggctagatcctaagtcccctgtgtgtgcaggcccccaatactgtgccatctctgcatgccttttcccaaggagagaagggagtcctactcccagttgggactgtccagactgtggtgctagaggtggtgtggggagcaggagggtcattcccatctctggaatgtggatcccgaggggtcagagcccaaggcccaccccagacagacctctgtctccctcagacactgaccactactttctgcgctatgctgtgctgccgcgggaggtggtctgcaccgaaaacctcaccccctggaagaagctcttgccctgtagttccaaggtgaggccgcagagcctggcagccgggggcggggggtgtatagagaacctgcgccccatgccaagtgctccatacagggcttctcttatctctttccatctcctccaggcaggcctctctgtgctgctgaaggcagatcgcttgttccacaccagctaccactcccaggcagtgcatatccgccctgtttgcagagtaagtcatggggagtagaggaagctgccatccaggggctcagagaaggtacatgtaaagcatgtggtcagtgtctggctcaggctgagtgagtactgagtggtagatgtgatgacggttattcagggcattggccaagcaccaagaaaacagtggttgcctagcaagcactgaataaatatttgtcatggaaaatagtggttcagaacaatagctatgcgggtgcaattgctagctcagtcacttgccagctggcgtaaccttgggtgaatcatttcattcccctgagcttggtttcccaccctgccacatgacattgatagtagaatccactcctagggttgttgtgatagtttatcaaactgatgcacatacagctgtcagcacggggtctggcacgaggtcaagtgctcaggagtgggtggtagcaaatcgatggatgtgaagatacatagatgagggattgagtctgagtaggagtctttttgggggctgtgtggtgagagtgataccccctcactgctgccatctggcccttgtgatagaatgcacgctgtactagcatctcctgggagctgaggcagaccctgtcagttgtatttgatgccttcatcacggggcagggaaagaaaggtaagttaccttggcaactcatctgtacccacccatgccagccctgccttatctatgtggactaggcctaggcctggcccctgctcagccctgcgctctgtttctcagactggtccctcttccggatgttctcccgaaccctcacggagccctgccccctggcttcagagagccgagtctatgtggacatcaccacctacaaccaggtaacaaggtctccagccacacacacaaacacaccgctggtccccaggaccagcctaccctctctgcttgcttcttagccctgcctttgtgtccccaggacaacgagacattagaggtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatggtgagtgggtggttggttggactgctgggttgcaacggctacagagaaaagactcacaatcccacgtctttgccgttagatgattgggttgtatttagaccagatttccagagtcatatgctgctgactgtagctattccaagctctacgattttgggtaggttcctaaactccccaagcttcagcatccacatctgaaaaatagagtatacttagcaaattggatgagatgatgtgaaaaatggagttagttcatgcatttgcttaatcaaccaaatacttttgaattcatactaagtgccaggcatagagtgttgaataagacagaggacactgcactcaagaaatataagtctactagctagggcaggtgtcagttaattaattacagttgtgttcagttcccttaccaagggaaagagcagaatatcctgagaggacctggattgggttcgaagggggcacggtgttcgtcacgtaagcacttcaatactagcaacctattgtcatcatcgcttgttggctggggaagacagggatgattccagaacccagattgcccagtttcagtggcagggctgttccccatctactcactggcttgggactctgaacatggcctgggcaggtggggtggggagtgattcttacctttggcagctgttaactgttgatatttctttacacagaggcccccccagtgcccttcctgcatgcccagcggtacgtgagtggctatgggctgcagaagggggagctgagcacactgctgtacaacacccacccataccgggccttcccggtgctgctgctggacaccgtaccctggtatctgcggctgtatgtgcacaccctcaccatcacctccaagggcaaggagaacaaaccaagtgaggacctgagtcctgaaccaggcccccagcccgccctctcatgtcctctccaggtcccccaaactctcatttcccagggtagttcctgaagtacctctgaaaagctacacaggcataaagagtaaggaatagtttctcaaaactggaacgggagcctcactgtgccaggttcagaagtaatttataaaacagcaataattaaaacacataatactggtgattcttaataggactgtacaaggacagtagcttcctttttcacttacttttgcctcctttctggagcattgggttttgtgatgattcatagactctttaaggtagggaaagggtttggcaacgttaggcttttgaagctaggaagatagcagagctggagtagatggtgttttgcttccttgggaggggtaaagaggtacagttaattaaatttttttatttctatttttattaaaatttatttttattttctattatttttctaaggagaagataatattagtgcttcctattaggtgccaggcatagcactaaagcacttgcctttctttggtgtagggggagactagtagtaaagtaaaagacctctgaggaagaggttgtaccatatcccaaacggccaaacttaaaaacctttcagtactttagttgattcctatattttcaaacatacggtgaatagtttcacttattttcagcaccattatttgtaccaccttcaaaatctctatttcagacatcctaactgcatattctataggtttttctgttattattcttttaaatcttctcctttggaaaatttcaaacccaaacccaaacagaatagtgtaataatcccctgtacacaccctgcagccttttttttttttttttaagagacagactgttgctctgtcagctatgccggagtgcagtggcatgatcatggctcattgcagtctcagactgctcggctcaagcaatcctcctacctccgcttccctaggactacaggcatgaaccgccatgcctttaattttttcacagaggcagggtcttgttatgttgcacaggctggtctcaaactcctggcctcaagcgattctcctgcctcagtctcctaaagtgctgggattataggtgtaagccgctgcctgctggcatatcttaaagcaaatcttagacattgcatcaattaacctttaaatactttaaggatttttaaaaatgtaaccgtatcattaccacttctgttttcccctgtggtcttaaaaatgtctttttataattggtttgtttaaattgggataaacaaggttctcacattgcatttgctttatactaagttcctctcttgggtgggcacagtggtgcacacctgtaatctcagcactttgggaggccaacacagaaggaccacttgagtccaggagttcgaaaccagcctggacaacattgtgaggctccccctacctatacaaaaaaaatttttttttttttttttttttttttttgagacggatcctcactctgtcacccaggctggagtgcagtggcgcgatcttagctcactgcaacctccacctcccgggttcaagcgattctcctgcctccacctcccgagtagctgggactacaggcgcgtgccaccacgcctggctaattttttctgtttttagtagagatgcggtttcactgtgttagccagggtggtctcgatcttctgaccttgtgatctgcccgccttggcctcccaaagtgctgggattaaaataaattgtttttaattagctgggggtggtgttgcacgcctgtagtcccagctactcaagaggctgaggtgggaggatcacttgaacccaggaggtcaaggctatagtgagccatgatcatactattgcacttcagcatgggcgacagtgtgagaccctgtcacgaaaaaaaaaaaagtttctttttctttaaaattactagactattcttagagcagttttaggtttacagaaaaactgagcacaaagcacagagttcccatatactccctgtctccacacccagaatgtcccttattataaatgtcttgtctttggtgtggtactcttcagtctctcttcatctgtagcagtgcccatgccttttttttttttttttaatgtcatttatttgttgaagaaactgggtcatttgttgtgtagaatgttccacattctgggtttgtccttgtgctagtgtttaacacacccctcctctcctatatttcttgtgtgttggtggttagatttagaaacctgattagattcatgtcccacatttttggcaagaaaaattcccaggtggttctgtgaacttcttcttgcgtcacatcaggcacttggtgtctggtgccccagttgtagtgatgtgaagattgattagccatctgcagcactcctaacaacctctcttgatcgcatcctgggatcactgccctggaaacatcctctcccttttcttagcccctgctttcttcccttgcctgcctggcttctatgctcccaagcccatcttctaggcacccagattgaggctccatggcaagcagcagggacaggggcagcaggtagcctgaccccaggaaagagatgtgggtgaccttgcatgtctccaggttacatccactaccagcctgcccaggaccggctgcaaccccacctcctggagatgctgattcagctgccggccaactcagtcaccaaggtttccatccagtttgagcgggcgctgctgaagtggaccgagtacacgccagatcctaaccatggcttctatgtcaggtgggctccacccccacaggccacctctcatccccctgacctaccctttctgctgcttaccccttgatagggcagccagatgggaacacgggccatctctctgcttctctgtagcccatctgtcctcagcgcccttgtgcccagcatggtagcagccaagccagtggactgggaagagagtcccctcttcaacagcctgtaagtgtgaccacactcactgataacacatcctcagctgcctgctgggccttaacacaggtgaccaggctcctgcaggggagttcagggtagatgttacatcttccaaagagatgtgtagatttaattcaatcctaataaaaatcctggcagtctgtggaatttgtgaagactttataaaatgattttaaagtgcttctagaagaatacttttacttacagcctacatttacttcttgatgctcttaaatatttaatcaagcacttatcaaatgccaagtgcttctgagagcactgagtgtgcaagattaaacaaaacagacttggccctggcctccctttgcttacagtctagaaggaagattctggtctagagagtaatggggttagaggttgggtaggaattgatttactgggttatctaggaaggcttcatttaggaggtggcatttaggctgaaaccaggctaagaaagaagcaaccaagcaaaggcggggcccctttcctccacctcaacaccaggcgtctctctttctttcctttctctctctttctttctttctctttctttctttctttctttctttctttctttctttctttctttctttctttctttctttctttctctttctttctttcttatttattttttattttactttaagttctgggatacatgtgcagaacatacaggtttgttacataggtatatatgtgccacggtggtttgccgtacccatcaacccatcatctaggttttaagccccgcatgcattaggtatttgtcctaatgctctccctccccttgccccccgcccgccgctcccctttatcaggtttagagattgagctatgccttctgttgaaaggttttgagcctaagagaacattggaaacactgtgttgcattgcccaatactgccggaatgaggatggggtgagatggggaggagcagccagtcctgtctcaccgctcttcccctgaccccaggttcccagtctctgatggctctaactactttgtgcggctctacacggagccgctgctggtgaacctgccgacaccggacttcagcatgccctacaacgtgatctgcctcacgtgcactgtggtggccgtgtgctatggctccttctacaatctcctcacccgaaccttccacatcgaggagccccgcacaggtggcctggccaagcggctggccaaccttatccggcgcgcccgaggtgtccccccactctgattcttgccctttccagcagctgcagctgccgtttctctctggggaggggagcccaagggctgtttctgccacttgctctcctcagagttggcttttgaaccaaagtgccctggaccaggtcagggcctacagctgtgttgtccagtacaggagccacgagccaaatgtggcatttgaatttgaattaacttagaaattcatttcctcacctgtagtggccacctctatattgaggtgctcaataagcaaaagtggtcggtggctgctgtattggacagcacagaaaaagatttccatcaccacagaaaggtcggctggcagcactggccaaggtgatggggtgtgctacacagtgtatgtcactgtgtagtggatggagtttactgtttgtggaataaaaacggctgtttccgtggttctttgcctcttgtccttgagtcctgggaagagctggggactggggattgtttgctgagtgcctgaacaggacctcctaccctatgcctgcaaccccctccacaaaaaacaaaaaaccctacctcctcccacctggccggaaatttcttctcctgatctgctccccctgtcctccccatccccatctgattgtgattcccagaactccccgggttgtttgggagtgtttctgaaagcataatccatggccatggaaatgaatcatcctacttcttgggggcattgagagtcagtccacatcagcaagggtagagtggagaggtgggagggctctgggtggtgggtctctaactgtagtgtgcatcagagtcactgggggcacttgtgaaaataatgtatgttcctggggtccagatcctactaattcagttggtctgggtgtggcccagactttgactttttagcaggcttctcaggagctcctgctgtgctctgtcctcagaccacccccaggctttgaagccaggctcattggattgaagcccgccccgcccacctcccttgctggttacataaccctggatttctgtaaaacaagcctttaggcggttgcctcccactgccctcatcttctgtcttttcctctggcacacttggcatcaactgtgtgttatttgcagttccccccacctcctaccccactcagttctcccatcatagtggtttggcctagaatgccctattccaccaaccatgcacacctctcaactgcctggttccctcataaaaccagatgaggctggccgggcacggtgtctcatgcctgtaatcccagcactttgggaagccaaggtgggcagatcacaaggtcaagagatcgagaccatcctggccaacatggtgaaaccccgtctctactaaaaatacaaaaaaaaattagctgggcatagtggcgcgcgcctgtagtcccagctactcggtaggctgaggcaggagaatcgcttgaacctgggaggcagaggttgcagtgagccaagattgcgccactgtactccagcctggtgacagagtgagactctgtctcaaacacacacacacacacacacaccccagatgagaagttgctgcctccgggaagtttcccttgacgtgtccgtgccccacgcctttgcttccagattgccttggacttaacacgtgttccttatcagctggctgctgtcctttgacttccaccagatggtgtgcttcctggaggcacaggttctgtctttcattaagacctgacccatctcaggacatgtaagtgctcaatcagcaaacgctaaatgtattaactgggtatgggctattctggcttgagatctgggatccaagatagggatgggcaaggggcactctggaagctccacatgtgtgagtgcagcagtcttaacacagtggtacaggtgtctctgtagccagcatagatgggctgtgtaggttccttgaagggttttaggagccctcagcacatgcgggtggtatgtgtgcatatgtaggaaggaaaggcggtgagctagtctagaccatgggcaaaggcaatttgttcaaggtgcttttacttgagtttacttcaaaagcagtaaaggagcagactgtaaatgagacaggaacgcaggtgagtggatacacaaagctaagtggtctgtgtagtgtgcctagtgtgggatggagcatgcatagcatggggtgtctgccaagtcagaagagcacagagctgtggcctggctctcttttatacccgcagccctgtcagtacctagaaacgacctccactaccatgccacatgtaacctacgctctggcaacacccacatatttctagatcagacctcctccctggatcttggattcatttacccaactgcctacttgctttctccatttggatgtctaaagacatctcaaattgaatatctccaaaaccgagcttctgatgtgctccaccccaccccaaacaggcccaaccatagtcacctcatctctgtaaaaggtaattcgtgtctttccaggcactcaggccaaatacctttgagtcatccttgtctctctctcatcctgtttgcaccctaccttcaaaataaatccagaatcccaccccttttcaccacctccactattatcagtgaggttttccctggccataccctatttcaaattgctatcctagcacgctacattcacctggggaactgaaaaaatcctgatgcccaggctttacccaaaccagttaaatcagaatttaatgtgggactcacagagtctccaagtgacaccaatgtgtagccaagcttaagaacttggtcttatttttaaagtagtatgaaaacttactgtctctcctaagcattctaacaatggatacttttcagaataagattgtgtaaaacagagaactcacttttaactttataacaatttatgtattgtttgtctttttaaaacaaaagtatatgttgagtttataataaaagtaaaaatttgggccgggcgtcgtggctcacaccactcccagcactttgggaagccgaggtgggtggatcatttgaggtcaggagttcgagaccagcctagccaacatggtgaaaccccgcttctactaaaaatacaaaaattagccaggcgtggtggcgggtgcctatagtcccagctactcgggaggctgaggcaggagaatcacttgaacccaggaagtggaggttgcagtgagccgagatcaggccactgcactccagcctgggcgacagagtgagactccatcttgaataataataataataaaataataatttgatgaagacttaattaaatcaaataggcatctgggaggtctggccccaggtcttcccccagactgaagggtgaccacaggtgagccctttcaatatctgggccttggactcccgctgaggtgaaagtgaccgggtagcctgttggagccagccctgtcccataggctatgggtctcagggtcctctttcccaatagcacttcagctcacttgaggtcttttctgagctggtcatgcccaccaggcagatggcaaggcagggcacagaagctgctgagctccatggtgccaagggctgagctccatgagccagggctgggaggctggaacttatacctgcagaaaaagaagagtccctgtttccacaggacaaaggaaatatcttgtttttgatttcttggaagaggaagcactctgggcaagaggtatgagccgggatgaagtggactccttgtctggaggtggtgctacacaccttggaggggctcctgggagctactgagaatgtcccctaagtcagtattcctgcctcagctgaaatgccagtcttcagcctcatctactgcacacttgagtccatgagattttagagtggtaagtgacctttggggtctcagttttcctatctgtaaagggagtgggctggacaatgaacagctgttctccattcttttgttattggttcccatccagagcctcccagctagttgtctcaacatcccaggggagaaagcatagctctttgtccattggtttatttattcaatttaggaataatgagtgtattgttttatatgaataaccatacttatttaaaagatcaaactaaactaaatagtacaaacaagcgaaatctctccccaaagtctactatggtgctgtgcaacagaaatataatacaagccacaaatcgaattttcaatttcctagtagcttttttaaaaagtaaaaagaggggccaggcacagtggctcagcctgtaatcccagcactttgggaggctgaggtgggcaggatcacctgagctcgggaagttgaggctaatagtgggctgagattgtgccactgcactccagcctgggtgacagggaaggagaccctgtctcaaaaaaaaaaaaaaaagaaaggaaaaacaggtaaaattaatttgatgatagtttatttgagtacagtatatatatcatttcaatatataattaatatgaaataaaaactaatgcaatattttacttttctttatattaagtctttgaaatctgatgtgtactttaaacatttatagcatataacaactaatattagccataactcatgtgctcaatagttgcatgtggtcagtggctaccatattggacattgatgctctaccatataaagcaactatcagtaacttcaggataacctcatcaacattttgttagattgattaacaaaaataattctacaaaaatgaagagtttatggatattgttttccctgaatttttgcatattttcttaatacctgaaggacaattttatggggtaatattttaaaaaataatttgactttttttttcctctttctaggctattgagatttatttatttatttatttatttaagatggagtctctgtcgcccaggctggagtgcagtggtgcaatcttggctcactgcaacctctgcctcctgggttcaagtgattctctcacctcagcctcccgagtagctgggatgacaggcacgcaccaccatgcctggctaatttttgtatttttagtagaggcggggtttcaccacgttaaccaggctggtctcaaactcctgacctcaagtgatttacccacctcagccaaccaaagtgctgacattataggtgtgagccaccgcacctggcccaggctattggtacttactatccccaacttttattctatgctagtaatttgatttgtagctctgacttgtttcttccttgagattttcaatttatttgcagtttttttagtggtgttacctagatcttcaatttatttctttaacactcatttttaagggtcttttaaatttttatttattttaaaatatttatttatttatttatttatttttagaaatgaaatcttgttatgttgtccagggtggtcttcaacacctagcctcaagcaatcctcccaccttggcctcccaaagcactgggattacaggtgtgaacactgaaccactgaacccagcctaatgtcttattttattaaagtttttgttttttaagctgaaagccctcctataaatttttccttttatcagattttctgctgaattcagttatctgtgtctgtttcttttctccagcgtcctttcctttttaattttcttctttttttcctttcttccctccctccctgctttattttctttcttccttataactgtatgtagtatggtgcatagctactctgtcatttcccttcatcttcgtcaggctcagtttgggcaactctgccctgtcctttcgcttattctaattggtgtcagtatattctctttggtttccttctcaccatatctgagatctattgttatttccatccctaccccccaaattgcagtctgaagtttgcctctatacacttctgtggagcctaaagtcatggggttgagggaagaaaggaatgctattggagatgtctcttgactatgatgggcagcctgggctctgctctctggagattttcttaaattcctggaaccacagttggcttcctctagtgacgtgttattccatttttgagaaagtttccctggagctttggatcagccaaccaattagaaatttgagccttggggaatggcaaaccttggtgggctttttatctctgtggagaccccaagagcttgggtgggacttgaattttctggggatgcatcttgactttttgcatgcagttctctaacactcctccccaaaactcatattaaaatttaatccctaatgtggcagtactgagaggtggggtctttaagaggtgattgggtcatgaatggattaatccattcacagataaatggattaatggattatcataggagtgggactggtgactttataagaggaaaacacatagtttagcatgctcagccccctcaccatgtgatgtcctgaactgcctcaggactctgcagagggtccccacaacaagaaggctttcaccaggtgcatccccttgaccttgggcttcccagcctacagaactgtaagaaataaatttggtttttaataaattacccagtttcaggtattctgttaagacacaggacaagaaggctactcagttgcaagcaagagccatttcttatggaaaaggaagtgtgagtcagagtggagccaagaacctctggcaacaggtgcacaattcaatttcagaattgccggggctcagtgattgctctgaacttccccttttaaaacggtagtgaacatagtggtttcctgtgccaatctcgccattgcaggttgggtgcatgtgaggcagaaaacatgtctctttagttcacaggttttcagatggagagaaactctacccacggaacagaacccaagacgcctctttgcagctggacttgatgtagataagctccagaaattggagctgagtttgatgtcaaaataggatgaggtgtttgtttgtttgtttgtttgtttgtttggttttaagacaaactcactctgtcacccaggctggagtgtagtggtgtgatcacggctcactgcagttttgactttccaggctcaagcaatcctcccacctcagccttttgagtagctgggactactacaggtttgtggcaccgtgattggctaattttttattttttatagagatagggtcttgctatgttgcccaggctggtctcgaactcctggatacaagtgttcctcccacctcagtctcccaaagtgctgggattacagtcatgaaccactgcatctggccaagattttttttttttttttttttttttttttttttagtgggaagtagggcagtgggggtaggtggggacgggtcttggaggaagttatattttacatataggaaaattttaactaatctgtctcagtttaaaaacatgtctgcaatttttctggcacttgtcccattgagaattggggtcaatcccctttttgaatctgggctgaccttgccgactccatcatgatcagtagaatgcagtggaagagatactgtgtgatttctgaggctaggtcaaaaaaggctgtccttccatcttgcactcttgggatgctggctctgggtgatgctgatgtccatgtgaaaagtctgactacccagaggccactgctgaaaagaacacatgcagtggacaccggccaacagttccagctgagtttagccttttagtttagcctttctgccaaggccctagacatgtgattgaagccatcctgggtcctccagcccagcccagcccagctgggtaccacagaatgacctcagacatggccacaaggagcaaaagaattccccaactaagccccgcctgaattccagacctacagaatccacgtgcatcagaaaagagttgttgttttgtgccactaagtatggatcctggtaggcaactcactggaacaactggtgagaattttcaggacttttgtattatttcctctttctcctgcacctcttctggaacagagcagttggggataggaccatgacgaaacacatcaagatattctatatttttctgttgctactgctttttgaagtttatggaatgaggttctactgtttcccatggtggtttactgctgctgatttttttttttttacctgttttttttttttctcctatccaattcaatagaaaccagagaatgaacattctattgtgaaactatcctgccatctgcactttactcagtgatatggtttggatttgtgttgccacccaaatctcatgtcaaattgtaatccccaatattggaggtggggcctggtgggagctggttggatcatgggggtggatttccccctttctgttctcctgatagtgagatctcatgatacttggttgtttaaaagtgtgtggcacctcccccctctctctttcgcccactcctgccatgtaagacatgtctgcttcccctttgccttccaccatgattgaaagtttcttgaggcctccccagctatgctacctgtacagctggcagaaccgtgagccaattaaacctcttctttataaattacccagtctcgggtagttgttttttttttgagacggagttttgctgttgttgcccaggctggagtgcaatggcgcgatctcagctcaccgcaacctccgcctcccgggttcaagcgattctcctgcctcaccctcccaagtagctgggattacaggcatgcaccaccaccctggctagttttgtatttttttttttagtagagacagggtttctccatgttggtcaggctgatcttgaactcccgacctcaggtgatccgcccgccccggtctcccaaagtgctgggattacaggcatgagccactgcacccggccattttttgtttgtttgttttgtttttttgtgtttttttttgagacacagtttcactcttgttgctcaggctgaagtgtaatggcgcgatctcagctcactgcaacctctaactcccgggctcaagtgattctcttgcttcagcctccagagtagctgggattacaggcatgtgccaccacacccagctaattttgtatttttagtagatgtggggtttttccatgttggtcaggctggtctcgaacacccgacctcaggtgatctgccctcctcggcctcccaaagcgctgagattacaggcgtgagccaccactcctggtgtcaggtagttctttatagcagtgggagaatggactaatacacccagaagtctatgttttaaatgaaaacttaattttaaatagtacaaaaatatttgtaaggttttttattttcttaatcataaaaagaacataagagattaaataggtgatattaaagaaagaaaaagaacgcccatgttcttacaacactaatacaatacctgtgaacattttgtttctctttcccctacatagcattattttttgtctgttgattgaattccctcccctcccaaagtttttttttttttttttgtattaagccaaaccacaaataagtatcatttatgttagatgccgtgctaggtgctgctgatacaactgagaatatgtcagatacagccccagccctttttgatttagagtctagctggtgaggtcatttaccaaataatgatgcataatcattccataaatacaaatgatggtgttatgaagataaaaagagggtgctcagaaagaactaagggggtacaatttattttattttagaaattcttttagattcagaaagtacgtgtgcaggtttgttgcacgggtgtattgcatgatgctgaggtttgggcttccaacgatcccgtcgcccaagcagtgaatatagtacccaacaggtagtttttcaacttttgctctcctccatccccccttctggaatccttagtgtttattgctcacatctttgtgtccttgtggggatgcaatttagattgaggctcagggacagcttctgtgagaaagtgacctttaggctgagcagaaggaggtggcaggaatgtggagggaagacaatccaggtgacgggaacagctccgaggtggggaagagctcccagtgatggaagaggcagctttgtggccagagctggtcagcatgggagagagtgacacaagggcctgaaagaggacccgtgtggccatggtaagcccattggtgatgaagccaggggcaccaggtggacctggtaaaggaggacagatttcacattcacaagaatcagaatctactgaacgcttttaggcgggtggagacacgatcagcttcattcacttccttcccccatacagtatttacttttcactgaggtgtgatataatgtatccagaaaaaagtgcagaaatgtataacccagtgaattttatagaacattaccagcatcctaaaagcaccccttccactcattcccctagagtaaccactatcttgacttccaactatttgcctgtttttgtactttccatgtaaacgcggtcatccagcaggtgctgttttctatctgggtttttaactcaacgctatgtttatgatgttcatccgttcattacatgtagttgtagatcatatttccttctttaaaagatcacactggctgtagcatgaagaatgagcaatttcaaaattaagcaaaatattaaacagctaagaatggaaataaaattcaagtcaatttcaaaaagaaacacagggacagattttgccagatacctggtacagattttgccagacatatggtacattttgttcgttactatatctccagaattttcctacctctttctccaaatagagaatatttaaaagttttcttaaaaaccctgatatataacatttgcaatgttctctacagtttgcaaagtgttttcctaatgattttctgctttgatcctgcaaaatcttatgaatgccagtaccatttcccttttacagaagaagaaactggctcaagaagatgagacatgatgctttgtagccgaggaattgcctcaggtgtcaccatccccgtccctgcgaattggaatttcaggcgggggcgagctgctggctctgccggcaaactcgccttatcccacgccgccgaagggtccaagctttccagctgcgtaacacgaccaggccccgagcgctctggcccgggggcagatactttcggtttgcagctctcagggcagcgctgccctgggacgcccagtgggttttcacggctcccctgggtctgggatcagggcagctccgcctaagggcgcggcccaatctgagggttcgtcgcccccgcgtggtcagacgtgggaatggcagcttctgaagctctatgtgtggtgcctttctggggctcaccaggtgccatgttgcgtgggaccatgaaactgtggtggtcttgtctctgccacaagataatgtaggcttgggcctcaagataatgtcggcatggtgtcccatctttggcatgagtcctaccctttccaagtgcagtggtggctgattcagtggtggctcccagggatatgataggcaaagggggttcggtctctgctgtctgaaattaatcctgggctcaagagagaggggcgcaggtgaggcctggggctcttcatgcctgatttcccgctacccctctggcttcctccaattcctacatccaagttaactctgagacctgtggttaccaagaagacagtcgatgtgggggaagggcaaaaccaagtacctactatagctacaaggaataatataaaggaattgttccattttgtatattggtatcatcagcttcttgagaagccttttgggtaatttattgtaaaaatcactactttaaagacaaaaatccttaattttaaatgctacaaaatttaagagctcgtttgagttgatgcaggacccacagttccctatagggcgatcactgatgagtgtatgtgagctaaacgcacaggagcttattctcgagagttctcaggaattctccggaattatgagaagcatatcaaccgcttcatcgggggggctccacttggcattttacagggagagttgggcagttcccttctcaaggcaaacagatcttacagtggcgtttattcagataaatatgagagccgtgtgggactggctgtatgatgacggggatatcctcccactgaatatgcctattacccaggtcatggtaaatctgggggtttagggggccccttttacatgggtgcccctcccacagaatcatacaactgtttgagaaggcttctcaacttgtcatccgtcatgggtcttacagatgccactccctgctgggaaccagaaaaggtaaaatggtctggaggtaggaaaaaaaagttcctaggaccagaacataaaacatacaggttaatagaattatgaaatttaagatgtttaaaaaggctttatgtaaggtacttgcaacccctttacctaaatatcttatgaaaatgggtattgtacaaaaattagctatagcatgttttcaggtaaagttccagcaaagcaactaaaaaggggcctatatagccaatcattccctgctgcattttatgcaataatcaggtcaagtatataagactaaaactcactttgcacacaaattagtcttactgtaatttctctttaatagataaaaaggggctagagaaagagaaattgtttcaaaggaaaagtgtaacatttgatactagattttagccctcaatttttttttgagtgcagattgaatcatgcattatttcttggctacaataatcctctggagagtaccagattataatttttcttcatatctttagttggtgccctaatggatggaataggttctttttttttttttttcagatggagttttgctcttgttgcccaggctggagtg[139 bp omitted]tttcaccatgttggccaggctggtcttgaactcctgacctcaagtgatccacctgcctcggcctcctgaagtgctggaattacagacgtgagccaccggcccacaaataccctttgattgtcaaaacattaatgttattatctctccttgttttactttcaaggaagcccaaatcatggtattctgaacaccagagatgtcaatctccctcatttgtcatctcactgggccggatctgtttttcactgcagatgccctgctgctaaaactatacaagcatcctccctctaggtccagtgactgtcatggaagaggcgggtgcgtgagattgtaagggccagttttgagggatagagttaggtcaaggtcagaccctccaaatcaaggaagggtacaaagatgcctaaacagctggtaaaacaagggactttgtcttctaagctattatgtatcacttttgcatccaccccaacaataaacaattttctgcttcatgtagaattaaaatatttactgacaggataaagatgccttgtgacaaagcctcctgggtataatattcccagttataagttgtaaagatatatatacatatatatatatatatatatatatatatatatatatatatatatataaatcttttacagagcaatgcttatgtttttgtatagctaattgctgtaagtctgtaattaaaaccaagtttacagtagctgaatacataggagttaaagacaagttagtttttgcctttttgtttgttagctttttacttaaaatagcaataataattttaaagagtaatgaatgcctgtccatgtccatttccatctggcctgtaacatttgattggctgtaagtctcctttttttttttttttttttaagacggagttttgctcttgtcacctaggctggagtgcaat[136 bp omitted]tttcaccatgttggccaggctggtctcgaactcctgaccttacgtggtccacccacctcggcctcccaaagtgctgggattacaggcgtgagccaccttgcccagccagctgtaagtcttttgactcttggtcccttatccatagggaatcccatcgagggacaagatggaccaggggcaggccgccatggcatcccagaaacactatgggacataatgaagatttgctggccattgatgttgcctctggcaattcttggccagaagtgggagaatgtaaaccaaaaataaaattctaagctcccctcatcccccacccccgcaccacaaccatctaaatgagcttcctccttggccagggcactcctaaaatttaacctgaaagactgattcaggccatgacaggaagtgggggtcgggcatgcctcattatactctccagtgttaacatcaacagagaccttaagcccaataagaatcatgtacattctattctctctgaagcctgctacctggaagctccatcctccgactccagttgtcccacctttctggaccaaaccaacgtatttcttaaatgtacttgattgaagtctcctgtcttgctgtaccccaaccatgttgggcacacattctcaggatctcctgagggctgtgtcatgggccatggttactcatatttggctcagaataaatctcttcaaatatttacagagtttaactctttccatggacatgggggagcacctgttggagacacagcatctcatcccccagacctgctgaatcagaatctgcatttcaagaagatccccaggcagttcgcaggcatgtgcacatttatgttgacaaaaagagtccaactctgtcaaatatttgaagagatctattctgagtcaaatatgagtgaccaatggcctgtgacacggccccaagagaccctgagaacatgtgcccaaggtgatcaggctatagcttggctttatacagcttagggagacataagacatcaatcaatacaagtaagatgtacattggtttggtccaggaaaatgggacaactggaagcatggggtgggggcgcttccaggtcataggtggattcaaatattttctgattggtaattggttgggagtttatttaaagacctggaatccacagaaggcatagaagggagtgtctggattaagataaggagtcatagagaccagcgttcctattatgcagatgaagcctctaggtagcaggcttcagagacaatagatggtaaatgtttcttatcagacttaaaaaagtgccagactcttagttaattctcacctgaatcaggcaaacaacctggaaagggaaggggattctctacagaatgtagattttccccacaagggacagttttgcagggctatttcaaaaatatgtcaaaaaatatattttagggtaaaatactttgatttctttcagggcctctctgacatgtggtacttacaccagagtgaggctggaatttggtatcctattgctaatctgttttgttagtcttaagatctctgttttaatgttactgctggtcagttgtgcctgaattccaaagggaggggagtgcaacgtggcgtgtccaatccccccttcccatcatggcctgaactagttttccaggtttctttggaatctccttggctgagacaggggctccattccatcagttgggggatttagaattttattttgggtttacaacagtaagcaaaatgctttcctgagttctgagagtcattctagtgagttatccaacttgaggggcgattgtggaacactaaaatttgtatagccaatcagtcagaagtgtgagtgacccctggaatttgcgcttgtatctgaagtgagagcagggtcttgtgggactgagcccttaacctgtgaggtctgtgctgtaaaccagaaataaaattctaagcccccacccatctgaatggacccctcctcttggccaaaggcgttccaaggttaacctgtaaaactagtttaggccatgatggaaagggggaattggacattagcactaacatagaccttaagctgataagcatttacaacctcttctctctgaagcctgctaaagtggaggcttcatctgcatgatgaaaccttggtctccacaaccccttacctaacccagacattcctttctactgattccagatctttagataataaccaattgccaatcaaaaaatctttgaatccacctgtgatctggaagcccctcccatctttctgaactcaaccattgtacatcttacatgtattgattgatgtcttatgtccccctaaaatgtataaaatcaagttataggccgaccaccttgggcccacgtcatcagggcctcccctgagactgtgccacaggcatgtccttaaccttggcaaaataaactccaaaattgagacttgtttcagatacttttggtttacagttctaactcaggagtgtcagaagtgaattaatttgtgaacacctagttggtgttggagaatttgttggtgttggaaaagatactgttaccggaaagaggtcccaatccaaaccccaaaagagggttcttggacctcgtgcaagaaagaattcagggtgagtccatagagtaaagtgaaagcaaatttattaagaaagtaaaggaataaaagagtggctgctccataggcagaacagccccaagggctgctggttggctatttttttcattatttcttgattatttgctaaacaaggggtggattattcatgagttttacgggaaaggggtcagcagttcctggaattgagggttcttccccttcttagatcatatagggtaacttcttgacattatgatggcatttgtaaagtgtcatggtgctggtgggagtgtcttttagcatgttaatgcattataattagcatatcatgagcagtgaggataactagaggtcacttctgttgccatcttagttttggtgggttttggcaggcttctttactgcaacctattttatcagcaaggtctttgtggcctataccttgtaccgacctcctgtctcactctgtgacttagaatgcctaacctcctgggaaagcagcccagcaggtctcagccttattttacccagctcctattcaagatggagtctctctgattcaaacgcctctgacaataccatgtatttggtgttaggaaaaaactctccagactcactcatccctgttctttggtggctaaggggagaaatgagtttgggtagctcctccccaagacccttaccagttatctgcattttaagaattctctggctgggtgcggtggctcgcagctgtaatcccagcactttgggaggccaaagcaggtggatcaactgaggtcaggagtttgagaccagcctggccaacatggtgaaactctgtctctactgataatataaaaattagccaggcatagtggtgcatgcctgtaatcccagctacctgggagactgaggcaggagaatagcttgaacctaggaggcggaggttgcagtgagccaagatcgtgccattgcactccagcctgggtgacataagtgaaactccatctccaaaaaaaaaaaaaaaggaattccctatagaagccagattcttcaatgattgagttgtggcttaatggtagcttgtcctggctccagcacttactagctgtgtgatcttgagtaagttacttattcttaatttcctcatctgtgcagtggggatgcctgccacacagattctttactcattttttactaaaatgtcttattctcaaagactttgtctacctacctccaagtaagaaaatccgatatgaaatcattattttatttcccccttctaagaattaatcagaaggatctagaacagcttaactgcctgaggcacctgtaggcagaaagcaagaaacttgttctgtattctgagagtttgctggaggtttgctcgagggccaaggtgtgcttctcccaggctgtcaagatattagtaataactccaggccctcactttcctatgtctcaactattatcctctcgagatctttgagtgtcttcaggctggtgaatctcatagcatgagagtgctgcatgttagagctagattcctaataaggaggtgacccatggtcaaatacacatttttctaaggaacttaattatccacattctattcaatgactgcagcaccccccactaccagtgagcatcaggagattaatttatttgacaaatatttgccaagtacctacaaggcattgctctccataagcctcacttcctgtggctttgctgagtttctaaggtatctctggctttgtggttctggggttgaaccacatgtgaggtgagggttgggcatggtggcaccatcctgggcaacaaaggaagactccatctcttaaaagacatctagggtgatggaggagtaggggaactgaggtcctctgctcagtccttgggctactttctaaattacacattctgattgccctctgctcctgcagtgcccacagccttcctccctccttccatcttcatgggctgaggccattccattcatgggctgaggccattccagaaggaaggtgaaggaagtgatgggggttgaagggagaggccctgggagcctgcaatagctgcaactggaaggaattgtaatcgcccaatgggttcaccttgcccactgcctagacagagctgatttctcaagacaggggaattgcaatggagaaagagtaattcatgcagagccagctgtgtgggagactggagttttatgattgctcaaatcagtctccccaagtatcccgggattggaatttttaaagataatttggtgggtaggggctcgggaagtggagagtgctgattggtcaggttggagatggaatcacaggggaattgaagtgaggttttcttgctgtcttctgttcctgggtgggattgcagaactggttgagccagattactggtctgggtggtgtcagctgatccatcaagtgcagggtctgcaaaatatctcaagcgctgatcttaggttttacaatagtgatgttatcaccaggagcaatttggggaggttcaaactcttgctgcatgattcctaaactgtaatttctaattttgtagctaattaaggcagactgttacccaggtaagaaggaggtatgttttggaaagggctagtgtcaattttgtttcagtcaaaccataaactaaattccttcctaaggttagttctgcctacacccaggaatgaacaaggacagcttaaagggtagaggcaagatagagttggttaggtctgatctctttcagtgtcataatttcctcagttataattttcacaaaggcagtttcagaatcatgccataagtcctccacattccccaagtacctggcttgtgccgatcccttagtccacttttctaccctcttctcttccagtcccaatccaactgtgctacaaagctcatatccaggtccaacccctgagaaacttctctcgatcccctagttggaaaaaatcattccctcttctgacctcccatgtcgagaccatttataacatgttagaactcgattcctaacaaggaggtgcccgatgatcaaatacacttttttccagggaacttaattatcctcattctattcaatgactgcagcaccatccccaccatcaatgagcatgagcagattaattcatttgacaaatatttgccaagtacctacaaggcatcgttctccatgagcacatagctgtaaacaaaacacagcagcaaaggaccctaccctctaggtgaggcaggcaatagaaaaataaggagataatatgtgagtcatgacaagcattttgaagacaaaatagtggaaggggataaggagtaatgggggtaaaggaggtgctgctcttttatgtagaccggtcaaagagcagaacctgtagaaagtaagtgagcatcgtgaccagctgggagaagagcaatgcaggaagaagacgcggttagtgcaaaggccccaggaagactgtgcctgatgtgtttgagcagcagcgatgaggccagtgtggctggggctgagtgggtggggtgggagagtgtaagatgatatggtcagagaggctgtgggggcaagccttgtaggactgtataaaaacttaggctttgtaagagagatgggaaatcacaggaacatcatgatctgattcaaattgtcacaggatccctctggctgcagtgtggagagtggcctgtaggggaccaagggtggagacagagggccagtgagtaggctactgcaccagtccaggcaaacactgaagacctgtgtatatgtgttgttccctcggtctgtctcaggtctgttgaatagtaagaatgctttgctctgttgaagatgattccgttctttacataagtaattaaatgtctttcctttgctgtttcctgatacctaaatgcagtaatatatgctcatgatagaaaacttagaaaataaagaaaagcattaaacaataaagatttccaactcctacaactcaaagaaaacagataaatcatcctactttagaggactaaatgtacaggaactcattgatttgctcatcaaaaggtgaagagggaagagtagcagccccaggtagagctacccagcaggcgaggctgccctcaggaaccacagccttccctttcctaatgatttctactctgtggcacccacacttccctcctcagggctctggtgttatcctccttctgggtctccatcatatctgctctcagcaaaagatccagctcattcatccagccccaagggacagggcttcacctccggacaagggtgagatgaatgaggtcttggacacagaatttaagaagtcaaaaacctcagccatcaagataaatcatattaaaatgcaatggtttaaaaaattaaaattaattttaaaagtccatgaacaaaatataaacatttaaaataaagacagggtccaaccttgcacctgcacagtcctgccttgctctctgcaccctaacccagccctgctcagcccaagagctttgaatctgaatacaaatcattccagacttcaagatcaagttaaagtgttaatcgtctaccagaatgtgatttctagctttaaaaagaaaaccaagaaaacaacttccacatcaatgcaaaggttttctcatttcaccaggtttttgttttccgtctgtttacctgatggtttactaaagaggtgaagaagtctgtggctgaatgaacacattgaataattgcagagacttaaattctcaaatattcataaaaatattttaccttttttttttttgagatgaagtctcactctgttgcccaggctgtagtgcagtagcatgatctcggctcactgcaacctccgcctccttcaattctcctgcctcagcctcctgagtagctgggactacagacacatgccaccatacctggttaatttttgtatttttagtagaggcagggtttctccatgttggtcaggctggtctcgaactcctgacctcaggtgatccacccacctcggcctcccaaagtgttcggattacaggtgtgagtcaccatgcttggccatgccggttgtttctgctgcttgctgtgtagaccgctgtgatgaccatcttcttattgaccctcctttgtctctggagccccgccacctgccttctacctggagccttccttccaggtccttcttcaacatcagctccaggatctgcaagatctttggatatggccgctgcagaaggaaggagaaccacttcctggagaagcaggagtgagccaggatctgccacacaagagagccgggaacccagggcatgggttaaggcgaggagcaggtccggagggaagatctgaggcaaagaggtagagttcacaggtcctacacccctcgcacctacacagtgtccctcctctgatgctgaggctctctctgccttccgaggagaaagtggcgacgtgtcctgtgaaaccgcagacttaacacatcttccaaaagccagcttggcaggaggtcactgctagaagcacctctgaaataatctgagccgtcttacctgttcccctttttcagatgggaacactgaggcagccaccctgcagagtgagtctgcagtgctcctgagccacccccctccaggcttggcaaactcactgccttcttgtctgttgccttgactgcagggaggaccagaggtgctcatttctgggagggtctaggatctgccagctgcacagtgtccaagtcaagggcttcagcaacgacaattaacaaattcctttctctttgcagagagcctgtcacctgtgctgccttgagatgctgacatctgaggatgccccagacagggcctgtggctgctttctgaaatagtgcagcaccttctctgcttcctcctcaaccttctccttcacagcagaaccctgcctccttcctctccccacaggcttgtttcagcattgatttgatcaactgagcaccacgagaacacaaaccacattcctttgttttttcatcacgttacccccagcacttaggacagtgcctggcacaaaggaggtagtctgtaaatatttgcgtaatgaatgaataaaggagggcatgagtacatctcctctgcccagcacggatgacaggctgagggtttgaatccaggactctctcaccgtagccctcattctcactgcatcctcaccttcgtcctccaccccccacccccccactgggttccttggggatggcaggggtggagttcctggcatccagttctgagcatcagctctgccaagtagtggtggcgggggggttttcatgaaagaatccccctcgctccctgtgatgttggacatttttccttgtctgtgtagtttcaggctttgtctctctggccttatacaatatttaaaaacattcattttccagttaaacaaactggattggatactgttgtttgcaactaagaaccttaatattgggtgatcttcccaatattttgcagaacagcagcatcaccgcttttcctgccatcagactgggccctaccagttgtaagaagaaaacccattgcaacacctacctcttaatggccactccaagctacacaaaaacctgagtgatgtttcaacattaaagccttttctttttttttttttttttttacttttgggccaggtcagattgaggggtaggttgttctcctggtctctctgaaggagaagggaaggagcatgagggtcaattgtctgcttatctaagaaatccccttccctgaagttgtgtgtgtgtgtgtgtatctctgtatgtgtgttgtagggtggtggtggtggtttgttatttcagttacagcaataacaactacccatttagtggacaccgaccatgtaccaggctccatgcttagccttttacacgcattatttcatttaattcccaagaatcctgtgaaggagggtgcattatggtccccagtttacagagggggatatggaggcacggtgatgtcacgtaactgccatattgttttcctggggcaactagaacaaaggactacagactgactggtttaaacaactgcaatttaccctcttaaattctggaggccagaagtgtgagatcagggtgtccacagggctgcgtttgctctgaagaagctggggaaggatctgttccaggcctctctcctggcttctggaagctccttgacttgtggtcacataaatccagtcttcacatagtgttctcccgtctgtcccctttttaaggacaccagttgtattggattagggcccacactgatgacctcatcttaacttgattacctttgtaaagagcccatctccaaataaggtcacatttggagggacctgggggttacgactccaagtagcttttttgggaggacacagttcaacccataacagctgataaatggcagaacccaggcatatgtgacagacccaaaggctttgtcctttgggaggaagattgtgtaaattagagcccagactttccagccaggctataaaagtcctaattctgggtttgtctgaatttgggaatttggggatctaagaagcagcttattaggtaaggtgggcgtgggggtgagaaagggtgaggcatcaagccccccatcactgtttgtgactgagcttaatcccattgggaatgctgggagcagggccagacaattcctcgcagcagctatcaccccctttccctaggagagcaagtgtttatgcaccagtggagatattcaggcaccagtctccatatggactgagggtttccggctgatctgggcctgggccctccttgtgtggcttccaaggaagccctcaggcaaagagatgcagacactagcacttggaaatcagctggtggcaccgaaggagtcaggtccggggtaagggtagggcacatatcttctgccacactctgtatgtggctttgaacaagtgatttaacttgtaggtgtgctctgtacctgtcttctccctgtgtggggttgttgtgtagctaagtgaattaacacatgctgagcccttggaccatgtaatgactgcaacttaaacattaactatgattattattgactaaatgatactgccccctactggaaaatgtgtgacccggacatcacttagaaactagtgctggatggcatttgggagggaatctgatccaacttcctcatttcacagatgaggaattcagacctaagaaagggaagtatgttgcccaatgtcacacagctaacatatataatcattataatagacaacccaggcagcctcattcacttgttcattcattcactctcatgtgtgtgtatatatgtatataattatatacatatataaaacagacatgtatatagcatatattatgtgtatataatatacatattttatatatttatacatattatttctattaatatataattacatatacacatgtgtatatgcacatatgtatataattatatacatatgcatataatatatattatacatgcacatacacatgtatataattatatacatatatatgcatatatacacacacatatgtatcactagtgtttgtaagtgatatccgggtcactcattttccagtagggaatagtataattatatacatatatgtgcacatatatacataatacatatgtttttagagactgggtattgctctgtcacccaggctggagtgcagtggtgcaatcattgctcattgtaacctcgaactcctggcctcaagcaatcctcctgtctcagcttccccagtagctggaactacagatatgtgccaccatgctcagctaattttttaactttttgtagaaacagggtctctccatgctgctcaggctggtttggaactcctggcctcgagcaatcctctggcctcggcctcccaaagtgctgggattacaggcgtgagccaccacgccaggcctcactcctaaatattaagcacctgttttgtgataggcaccaggaaaacagtaatgaccaaaacggtagcctccaaatttgtttgatccctcacaccacccatttcagtaaaaggtttttttgtttgtttgtttgtttgttttgttttggagatgggggtctcactctgtcacccaggctggagtgcagtggtgtgatctcagctcactgcaacctccgtctcccaggttcaagcgattctcctgcccagcctcccgagtagctgggattacaggcgtctgcctggctaatttttgtatttttagtagagacagggtttcaccacgttggccaggctggtctcgaactccggaccccaagtaatcttcccgccttggcctcccaaagttttgggattataggcatgagccactgtgcccggcccaggaaaaggtttttgagtgtgcagttcccgtatttataagtatgtgcatattgttgtactaatatgtacattataagtattcaataatataaattttaataaagtataggctagaaatgaataaactgaagtttctaaatattttctttctgtaccacagtgcaccccacttaggagttggctggaccagaacaggggagacagaggaatagtttcagcagcacaaacgctgcgagaacccaggtggaggcccttaatctcacctgaagaggtcaaggctggcgtcgcagaggaggcagcgctcatcctggattttgaaggatgaactgaattttatcaggtagaaagaaagaggaaaacataagcttttgggtgtggcaaagatgtgggcattagaaaaaggattctaatttcctttacctcccgcctctccgaaaggagtatttgtattggtttccaagtagctgttctgcatcataggagaccccagcttattcctcaaagttcacccaaccctgaatataggtgaacctggagtgccgtcagtgggtagaaggggaagaggagtaacctaggagagatgggggaaccacctcatttgcatgagagtcgtgcccttctcccctgtagcctgagtttcctgcttccctctgctccacccagctcatcaggagagagcccactacctttcttacctctaagaagcagacccatggggggagtggcataggtgtgtgcatgttgggatgggagagggatttggtgctggaagaagaaaagttgggaaaggcttctgaataatgaaaacccagaatttcatagaagtcagctcattagtcagccttagctttcgtactttctccaatgggaagctcacctcctcttggcaccaggttccagctgatagcactcattattagaagagcactcttgtttcccattaaaccagcatatgggccaggcatggtggttcatgcctataatcccagcactgaggcaggtggattgcttgaacccaggagttcaagagcagcctgggcaacatgttgaaaccctatctctacaaaaaatacaaaaatcagctgggcgtggtggcatgcacctgtagtcccagctgctcagaggctgaggtaggaggatcacctgattctgggaggtgacgattgcagtgagctgtgattgtgccactgtactccagcctgagcgacagagtaaaaccctgtctcaaaaaaagaaaaaaaaagaaacaaatatgtgtcccctttgcccctggcccttcatttccacatgggtcctgactactctcaagaagcccactaaccaggtcagctgtctttgtactaagacagttctgcagagattgagaaatggtaatcaaagtacttccacctcccacaaagtgtatttttggttcttgtgcaacattttgctaagtcccctccaggagctttcagtctcttaggattcatagttaagagaatctctttttaaagctccctacaatatctgcagaggctgccagatggtagccccccttgtgaggtgcccctcactggggatggggagagaggcaactgtaggaagaggagggtgctcagtagggtaagagctcctgagtcaccccctgccttgcctcccccagttaagcaagagctgtggcaatgtaattcagaaatagaaaagaggatggctgagaggagggggtaggaggtaggtggtgggcaggggtccaaggctcatgaaggtatttctgaggatgcaccactcttcaagttcattattagaccttctagctgcaaggcatcatgggaacaatctgtttggaatccagtgggttcccagccaaagagacgttctcgccagctcctccaggcagagctcctttgacaatgcattcacacacctgcctccgagaagatgggggctggagggacctttggagagcaaagtctaactgccttgctgcagatgagaaaaccgaggcatagagtgctggaatagcagggattgttaaacaagtgaggacatagactgggcgttagatacagctagttctcactcactgccttgtggtcttgcatacgtttctcaacttctctgaacttcagttttcttattgataaaatatggatgatgacaatacctgtcaatatctccagccagagaccactaggaatacccctcttcctagctgaactagaagtcgaacaatgtgcgtttattactcactaaggcaaaggagaatacagacctgggtgatcacacagtgacatctcattaagaggatgttagaaaggacttctaggactcaggcttgtgttcgttgatttggaggacggtttaaagaagcaggctttgctctgcatcggatgctcaggaaatgcagcagttctatgactgggtatcttaatacatcttagctgtaagaagggatgactggatggagattagagctgtaagaagagcagcagttggtaaagaagcagccgatgttcatattagccaggggagagggctgcttggttatttttgtggcttgctcatgttttgtctgtgttcaaacatggttacagcttaggcagttttggttttgatctgtcatgggcagagcatggccttgtctgacattgatgttttgcaaagttgttcatgttcagcaggagaacatcaaggccccgctgagtgtcaggacagctcctggaagtcaggtctgctcttttctcttctccttttcttttcttttcttttttcttttcttttcttttcttttttcttttcttttcttttcttttcttttctctctctctctctctctctttctttcaatacagggtcttgctctgtcacccaggctggagtgcaatggcgcgatctcaactcactgtcacctccacctcctgggttcaagcgattctcatgccttagtctcctgagtagctgggattataggtgcatgccactgagcctggctaatttttgtatttttagtagagacagggttttaccatgttggccaggctgatcttgacctcctgacctcaggttcaggtgatctgcctgctttgggctcccaaagtgctgggattacaggcgtgagtcagcctctgctttttttctcatgttgatctcacagaatcatagtgataattaaatgctatgatatttgtgaaattccttgtacaagtacctggcagaataacttctcgataaataatgcttggatgataaaagtaatagtaataatattcattagtaataataatcaataagtttataatggaaaagagcttggtacttatttattttttattttattttattttattttttttgagacggagtctcgctctgtcgcccaggctggaatgcagtggccagatctcagctcactgcaagctccgcctcccgggttcacgccattctcctgcctcagcctccctagtagctgggactataggcgcccgccaccacgcccggataattttttgtatttttagtagagacagggtttcaccatgttagccaggatggtctcgatctcctgaccttgtgatccgcctgcctcggcctcccaaagtgctgggattacaggcgcgagccaaggagcttggtactaattagaggggttcggctttagtagctattaccatgtgactgtttagtagatattactgtgtgaccataagcaagtcacttcacttttctgagccagtttccttctccgtaaaataggggaaaaagcttgatgcggtggctcatgcctgtaatcccagcactttgggaggccaaggcgggtggatcccttgaggccaggagttccagaccagcgtgaccaacatagcaaaaccccatctctgcgggatatctaggcaaagatgttgagtagacactgatttatccatgcactcgttcagcacacgtttcttagaaagggtattcggtgattgaaagtgcagaccagactccatggattcaaatctgactctgccaatttactggttgtgtgcgcaagtcacttcacttctctgtcattattgatgcatctgtaaaatggggttggtaataacagctcctgcctctttggttgttactgagggaggggaggttaatacacgtatagactttggaatagtgcctgcactcaggaaggactcaatagccatgctatgattgagtgccgactgtatgtgctgggcactgttctaggtgctgggtcacaagagtgaaggcagcacacaagctccccaccctcctggagctgacatttcagctggagagaataataattgagtgagataagtttcaggtggtgataactgctatgaagaaaagaactcagggagggagggatagccctgggaaaaatacctaatgtaaatgacgggttgatgggtgtagtgggccagcagggcacatgtatagctacgtaatgagcctgcacgttgtgcacacgtaccttagaacttaaagtataataataaaaaaaaaaaagaaaataactcagaatacaaggtgaagaggggccagtttaggcaggatggttctgagtggagtgaaggaaggagccgtgtaggcctctggtggatgcagaagaaagaatgaatgcaaaagtcctaaggcaggaacaaactcttcctgcatggcagaaaaagataggcaggggcttgatcacagccatgacaaggtatttagattgtaattccatgtacagtggaaaccacagaagggcttggaacacgaaagtaacgtgatctgatttaatttttaaaaggtcaccagctgccatgaagagaacataacacaccaacaatggagagaggtctggaatggatagagatctgaggtttttcacccagttggaaaatggtacagcaggagtggctgacatggcccaggggttgtatatagaatcacaatgataggaaaagggcagttctgctcttgccttaccgcgtgatcctggagagtgtcacctgtccctcaggttctcgtttacaacagaaggtggcgccacgtgtgataattcaagcatcccttttaacactcatgtaatcatgtaatgcagccaataaacactgccacaaggatctgttttacagttatgctccttagaagcatttatgaagcatttcacacgaattcttctagtacttgctgggaatgtccctgcaggtcctgtgctatgctgcctgaacttgggatgccaattcagccactgttttctcctctgtaaggtggggatgacaaaatctgctctgcccacttctcaggaatgcatgaagtatgacattagagaaagcctggcgaagaagtttttgttttttgagagggcagcatggagaaggggtttctttcttttcttttcttttcttttttttagttactttacatcatggactttttttttttttttttttttttttgagtcaagagtctcgttccatcactcaggctggagcgcagtagcatgatcatagttcactgcagcctcgaccttctgggctcaagcatcctcccacctcagcctcctgagtagctgaaactactggcacatactaccatgcctggctaatttttaaaaactttttggagagacaagttatgttgcccaggctggtctcgaactcctggactcaagcgatcctccacctcggccccttggctgattcttttggaactttcttccttgtgtgtaaatttaggtgtgttacctaaattgttactatttgatttttcagatttaagacttaccactatggaaaacgaggacttggctttcttttccacctgcctccatgacttttacaaaccctttctatgactcatcctcccagtggcgttatactataatgttaatccgatcaatattcgatattcaggtttaaatccaggttctcattcctggacttttccccatacctgttgagacgacactacatacggcttccttcaaaaactagaagcatctgggaaatggagaattctagcattgcttctccttcttagggagatggtgttatggataacagagagttaatagcacaagctttggtgtcagaaggactagagtgtaattcctggctttgctggtcatgcctgcaagactcaagccaattgctttctctgccaactttggtttcttcacctataaagaggtgtgaggttgtggctgggcacggtggctcatatctgtaatcccagaactttgggaggtcaagccgggcggatcacctaaggtcaagagttcgagaccagcctgatcaatatggtgaaaccccatctctactaaaaaactacaaaaattagccaggtgtggtggtgtgcgcttgtagtcccagctatttgggaggctgagacaggagaattgcttgaaccccggaggtggaggttgcagtgagccaagattgtaccactgtaccccaggctgggtgacagaacaagactctgtctcaaaaaaaaaaaaaaaaaaagaggtgtgaggttgcatgtaagcttcttaggtacatgcctgaaacatagtaatcaattaaaatgagcttttatattccgcccacatcctgcaaagaaaataacttctattgagagattactcagttggcacataataccgccttatttcttcttccaccacactccctccattttcccatgctacagaggaaaacaaggcattcagagtgtctcagcgacctgctgaggtcacacagcaacaagagtaggggagcagtgctgtgcacctgtgatcccagctactcaggaagctgaggtgggaagatcccttgagcccaggaggcagaggttgcagtgagctgagattgtgccactgcactccagcctgggtgacagagcaagagcctgtctcacaaaggaaaaaaaagagtaggggcaggattcccactgaggatctgctcatctgacttctggaacaaagaagtggacaatgaaagaagtggagctcaaggcccctgccttatggcccagaaactctttcttggactgggctggggactggcgtgtcctagctggctgcacctcacagggcacacatgggggagactcagcatctggaaagtagggtgttactccctactcctcttaccttgagctagctctccagtgggtttcgagcttcagtgcacaatacatacatgatctgaaaagcctcaagctgcaaatctggtttaaagaggtcctgtgtgagttgtgtctccagaaacttggcagaaatgaagtctttctggaggaatctacctttgagtcctcaaagaattcccacaagataaagttctaaggcacgagagctcacagtcaaaaattacaaaataaaagggaagcaaggcctggtgagagtcaactgaaatgacagaggatgcaacaaaacccacacagcctaagatttccaaggatagaaaaacaagaatatcaaacaagtgtattaaatatattgttcggggatgaacacatatgtggttaaactgtaaagcaaagcaaagaactgataagtatacattttaagttgtttgctctgagggggaaggaaagagaaatgacattataggaacacagaaggattcacagatcatattaatatcctgacagcaagcgctcatacatccaccacccacattaatttcacaagtgtttgctgtgttgttattctttgtattttcaacatgtcttataaatattattttgctgtctgtggtttcataaacacaataaaaatatagcttggggctggttcattctgattgcttgcatgagtgagtccaccttctccctaaccaccggacttcttatgttgggtaaatatatggttgcaaaattttttcctcctttttctaagctgggtggagaatgtcttccccacatgtttccagtaaattcagatgttgctttctctgcccatagtttccttaggcagagggaataaatccccctgctggctgtctagaacacttttttaaaaaccaatctcttatcagaactgcctgtttccttgtccgtctcccctgctgggccactgggcctcaagcgatcctcccgcctcagcctcccaaactgctgggattacagtcacaagccagtgcacccagtcccagattttgtttttctaatacagttccgctagttctattaatagctaaaatgtaaacactgaaaactcttttgaaactaaagaggggaaaaacaagtaaaagaggtttttaaaaattaaactaccatggaaactggtttacccacaattttggttcacaaccttcattggattacctattggggaaaacaaagtttagccatgtaaacaggttccaacttgccaaaaatataatttgggttcaaccatcttttgtaaactggtaagtttgtgttgctgtctcatggctagagttccaaggtaaaaaagataggacctttgtgcatgtactcatgtgtttaactgaaggttcttacctaggtgaacaggctattaaaatagttaacaaggaaataacttgaaatgatgactagatttgtctaatatctcagttctcatagtcatctagataaactcctaaaaataaatagggtaaatataaatgggataaatgcttgaaggtaaactttttgtttagtttaaaaatctgacaattatttaaaatgctcattggacatctgggtgatgtccaattaagaaagggttatgatatggggaaacatttctaagaattgtggagtcgttctcatttataatgctgctatctgagtacaaagccctagttgataactctttccttcaactttaatgtcagctcctgtaattattttttccctccagttctagccactgttgcagcctgatgctaaaacattttatttcaaaggtctagaaaatcaatgattttctccaggataacttgattctgtactcagactcagttcagcattgcttgcatcccagttttttgctaaaatttaaggttactaagaataaaaattctagctaatatataatcttttttttttcagagcaagtgtggaaatttatttttaaaggctttagaacagtaaagaaaggaaaatacacttggaagagccctgagtgggcaccaaggtcaagtgcctataattttatatataaaaaatgtgccaaagatgatgtgcctttttttcccccaagttggagtcttgctctgtcatgcagtctggagtggagaggcacgatctcagctcactgcaacttctgactcccaggttcaagagattctcctgtctcggcctcctgagtagctgggattacaggtgcccaccaccacacctggctaatttttatatttttagtaaagatgaggtttcactatgttggcctctgtttggcagtgtatgggtatgcagtgggtactcacaaatgctggttagacacctgcaggcttgtactaaggaccaggtttggcaaacatcagtgtttgagggagtctgatttgagagtgtggaagttgagaatcatggcaggagatggactctgctattcactactatgaatcaaccttggtccctgttcttgggggagaccacaggccaatggaaaaaacagagatgtaactaattgctggtagcgttatgagtaactctgttgggtaagccatttggtaggaggcagagaactggaggcaagacctatgtacttgcagagaacattgttagcaggactggcctaagggcacctttctcccttcattcatcagaaaggatcaaagctgctgctaggagaggaaaagggagctgggccagccctggctgtaaccctttacaagaaataaagctgtgaaagaacctgtggaatcattttcagctcagaacacagagcaatatttttactctctcttacgggtggaattgtgtcccctcaaattcatatgttgaaatccagtaccttggaatgtggccttatttggagatagagtctacataagcaatcaagttgaaatgaggttatagggtgatccctaatcaaatataactgacacactcagagagactattttattttatgtattttaaaaattttttaatttaaatcgtttttggggagcaggggtttttttgttacatggataagttctttggtggtaatttctgagattttttggcgcacccatcacccgagcagtgtacactgtacccaatgtgtagtcttttgtccctcatccccttgccccttccccccaagtccctgagtccattatatcattcttatgcttttgtattatcttagcttagctcccacttataagtaagaacatacgatatttggttttccatccctaaattacttcacttagaataatagtctctaactccatccgggttgctgcaaatgccattattttgttcctttttctggctgagtcgtattccattgtgtatatatgccacatattttctttatccactcattggtcaatgggcatttaggctggttccatactttcgcaattgctaattgtgctgccttaaatgtgtgtgtccaagtgtcttagaaaaagagaaaatttaaagagacacacatataggtagaaaattgtgggaagatgaaggcagaaaccggggtgatgctcctacaagctaaggaacagcaaggattgccagaaaaacttccagaagctaagggaggggcatggaacagattcttcatcacaaccctcagaatgcacccaccctgctgacactctaatcttggacttctgaccccccaaactgtgagagaataaatttctgttgtttaagccacccagttggtggtattttgttacagaaatcctaggattgctttgcaaaatattctctcttaatctatgttgagctaatgaggcaagaaatatcttcatattgtaaatttaaaaactgaggctcagagaggtgaaataactgcccagggtctcagaactaggaagtgatagaattgggactcaaatgatctcttcttgactccaaatctcaggctcttaccagttcttatgggatgggtagtaggggcaatttgacaaataatgaaactacttgcttgtttcttcttcaattctgttacagattgatttctgtgggttaacctcagtaatttacagcctgttctaattctgtatagtccccccacgggtccaacagggttataaagaacctcaccaacaatcttcgcctgctccagttacctattgctgcatgacagcaaaccatcctaaagctggtgtaaaatagaatcatttcattagactcatggattctatgggtcagaattttaaacaggacacaaacatgagaatggttcatttctgttccatgatgcctcaggcctcagccgggaagactcaaacagctgggggtgacgcgatgactgggagctggaatcagctggtgccttcttcattcacatggctagcacctgggctggcatgactgaaagcctgggctcagctgggattgctaactgtagcgcctacatgtggcctctctatgtgccttgggcttccttacaacaaggcagtctcaggatagtcaggcttcttccatggcagctcagggctccaagagctagtgttccagttaaaagggtagaaattgcaccatcatttatgatctagccttggaaaccatatagcattacatctactagactctcttggttgaagcaatcacagaccaactcagattcaaggaatgagatacaaaccccacttctctataggaaggtgatatggtttagctttgtgtctctatccaaatctcatcttgaattgtaatccccaggtgttaagggaggaacatgttgggaagtgatttaatcatgggggtggtttcccccatgctgttctcatgatagcgagtgagttctcacgagatctgatgtttttataagtatttggaagttcttccttcgttcactcttctctttcctgctgccttgtgaagaaggtgtctgattccccttctgtcgtgattgtaagtttccatgattgtaagtttctgctatgattataagtttcctccccagccatgaagaaccatgagtcaattaaacctatgtctccataaattatgcagtctcaggtatttatagcagtgtgagaagtgacgaatatagaggggtataaaacaactgttgacatgtttaaaaactgctacaacactcttggcctcagggtaggaaaatctcatgggtctcatgcttccctttgggatgaatatggctttcatggcagttgtgggtacccatcctttccatcctaggaaggaccagaaaaattgggttgtcatcctgctagtagacgaattagtaaccatggaaatgagtccaagctcatactactcactgcatgacattcaataagttgagagacaaggtattggggtactgaaggcaactttatttcagaaagccaacaaactgagaagatggtgaactaatgtcctaaagaaacatcctaagttaatagaattgtaggctctttttatgttgggaaggggaagagaaaggggtttgagatcaagaggtgatcaaggatcacagacatctgggtggcagtgagggtccaagggggtgtggtgaaacttctttgtccttggtcaggtcacaatgctcctataaatcatctttaacacaatattgttacttgtgtatacaccctccttatctcctctggggttaatttggggaagggactattagcaaccttgctttaaactataaactaaatttctcccatagttagctcagcctatgtgtagaaatgagcaaaagcagttaacctaaaatatgtcaccacaggagtggggtaggagtttggggcaaaatagagctagtttttgctaagcctccttttttactgctacaacctcacagcttctccctgtgactttatcttagggtggaaagtctaataaatcagacctgtctcccgatgtgatggactgaccagtacccagtaattcatgatcttttgcctaataaaaggaaccactactatcaatgctttgctaagacaactgcaaaaatcctcttactactagtccagtttccatagctgtcctcttacaatgcattcttcagagctgccagagggattttcaaaaattataaatcagatgattttgtcccccaatctcccagcttttactagcccatggcttcccattgcacataaaagatatgttgcttttcatagccttcagggtccttcatgatcttgttcttgcctagctctttgatttcatctcccttgattttaactctgctccagctatactggttctcttactcttcttggcattcatcaggcttcttcctgccttaggatctttggacttgctttaaccttttttggtaatgctcagccccagatgatgttgtagatagatgttacacatcattcaagtctcagctgttgataaagaagactcttggggtgagcttgatcaaggaatgtttgatgagacaatgagcccagggaaggtttgtgcagcatgaagtaagtaatgtagctggaaataaaagttggtatcagtcaaaaaggcaggctaaggagttcagcctttatcctgaaggcagtgaagatccagtagaatttacagtcaaggaattaactcgacaagtgcactgttctaggaagattatttggtttagggctggacctgagccacttcaaatagacaagctctgcttttcatgggtttttgtgcagagaccatgtgtattttttttttttaatgaggatttggtttgaacattattgcatgtatgccacaaggatcttaactgtgagttagaagagaatgagagctgagagaagtccactggatttggaaatgaggaacttggtggttacactggtatagggagtaagatctctttggttactagcaacagaaaccaactctggctgttgtaaacagagaagaaatttataaaaatgggatgtagtcggcatccattctcctttcctaataatatctctaagttagccagagttgaattttactgcttgcacccaatagcactaattgattcagtttagctctcagaactgaaggaaaggctaaaagaacacagcttggaaagaatggtaaagtcagaactgagttcttcccaggacacctctgagttagctccataaattttcaggtcttttatcattcattgctcaagattacagttctaggaacagtatttgattggccactctgcctgggggtagggcagacacattaattgacagtctccctggccccacctgtcttggtctggaggaagttatttcctccaaagcaaactcagggtgatttatcagaaaaaggacaaatgaatgctaggtgacaaaacaaaatagtcaatatatccaaagagagaggtttccatggaatgaaaggaagtttgactgagtccaaaagtctaaaaggagaggcccattgcatggttaaaggcaccttttttgttcctggaaacttcttaaatcttcaccgttaacttgtttacagtcattttagagtgggcatgtctacagctaattgacatcatctaccactataaacttttccttctttcctttctgcttcttttcttcctcctcttccctgatatatatttttttacactcatgaagtcaagtccaaaactttggatgcatcatctacgttaacctcagatagatctgtgtgaatgtgtataatattgaaataactgggacaacacaagtaatttggcaagagtcttccctctgatttactggctgtgtttcctccagcaagtcactttgcttagctgaatctcagtttcttaacgtgtaaaatgggagtaataatacttaatccataagattgctaaatacatataagctatctttcaccaaacacttactatgtgcccactccagaggtcacaaatttaaatgtcctcctggggtcaggtgagcactgtgaatggaactagttgcagagagggaggatggtggtggtggggattatgggaaactggagggaatgcttccctcatagaaaaagagtagctgtacttaggttctggttttcaaagtatggtccctagccctgcagcattggcatcacctggaaacctgttagaaatgcaaattctcaggttccagacctactaatcaaaactctggggatggggatcctgcaatctgtattttaataagccttccaagtgattctgatgcatgcttaggctgggcactgtggctcacacctgtaatcccagcactttgagaggccaaggcgggcagatcacctgaggtcaggagttcgagaccaacctggccaacatggtgaaaccccgtccctactaaaaatacaaaaattagccgggtgtagtggcgcctgtaatcgcagctacttgggagactgaggcaggagaatcgcttgaacccaggaggcaggggaagggaagggaaggggaggagatgggaggggaggggaggggagggaagcctgggggacagagcaaaactcagtctcaaaaaaacaaaaacaacaaaaaaaatgattctgacgcatgctcaattttgagacctgctgctctagctgatggttgttatatctaagattgcaggactgtgttgccagatcttttactttttccaagagaagctagaggtttatttttatatgaaattcgctacttttaaatcttggcaactaatttaaaaatttaaaacatactgtgtagttaataatgtatgtgctctagccagatttgcaacctctgatttatgctttttcctttaacccttataataatcttataaaacccttataataatcatccaagactgttaggatgatacacagtttatgcaggaagaagatgcaggcccaaaacatgaagtgtttctctaagtcacatagccagaaagtggccatggatgcattgtccctgattgggcatggatgcatttggttctaaagcctctgcccttttaaatgatgtaaagagaatatctataactatacctagcacggaacttggcaccacaaaagctaaacatctgatgccattgactgatgaaaattccttccccatccttctgcctggccctgccactctccctcagtctgtattcctgtaagagagagccaatcaatagggtgctcataagggcctgggaggagcaaggctgggcagtttcctggcccagggagctgaatagggcccggaagaaagctgttggcagcagtgcctggggctgaatgtacagtagccagctgggtccacgggctaaaaactggctgctcaccccagtgttctctttgtgccctagactgggtttcactagcctgttatgggctgtgttcccacctggctcctgccctcattgttgactgagctcagagtaaatagccctggcccctcccaataacgtccccagtccccaagttgagcatgagaagctgggggaggtgttctcagcatccattttggggacagtggccagatgtactcacatcaccaaaccctactcacctgtcactatcatcccagtgttcactgccccagggcccctctagcctccagcagcaaagacctcctggggcttctagaacctcagatcattggagcaggaagcacttcttgtctaactccctgggtaactctgttttggcacttaaccccctggattctaaagcttcatttatacttattggtctccttcgtcacaggagacacttatctgtggagcactcatggccatgtatccagtacctatcatgggtcaggcctggagtccctgtgtcaatcagtgtggatctactctcaatgctcccagtgagtacatggttgttccgtggcaggaacgttgcatttgtgttctcactgaagtcccatataggtgtcattttcactgatgatgtggcagctcagatccaggaaaggattcattccagggccctcaggtgggaagtggtggaggtgggagtcagaccccagaccctgtcaccccttcaagaccagtgctggagggccccttttgacgactttctcttcaccaagcgtcttgccctgcatatgtcacacagtaggcacccagtgaatatttacgacggaatggaaaaaacaagggcctggagggagagacctgggttcaaaaccttatttgtacagctttgcaggggaccttgtggtggaggtgcggtcctaaatccctaaacactcagttcctttgtcatatacagctgataacagtaactccccggtcagaggaccggcgacaattccttgagacaaggagcacagagcctggcacagtcagccctgatcaggggccggtaggacaaagagagggagacagaaacacacacccaaacggcttgagactgctaggtgcttcaccttcctgggcctgtttctgatgaggagggtttgtttattaataataagtgctatttctgtagcccctactatgtgctctgtatcactaccctagccctccatcaagagggatctgccctctcatctggctgaccccaaatcgaaccctttaacccgcatgctctactgcctccctgcgggccctgccttatcctcctcaaccgcccactggggacactctggagaaacctcggagtcttggaatagaaacccaggagccctgagccttggccctcaggccccaggagggaggtcaggagggaggcgtggacaagggtccggccgtagctggtcccgtcctggaagctgcttaagttcctggttcccaccggggccaagagtgatacctgatcctgggggattgtgaaatgacctcatgtggcagcccgcccgcggtgcccgcaaagccctccaccctccccttccccgctcggctccacccctaccccacgccccctcccgcgcgcgcggttaaatccccgcacctgagcatcggctcacacctgcaccccgcccgggcatagcaccatgcctgcttgtcgcctaggcccgctagccgccgccctcctcctcagcctgctgctgttcggcttcaccctagtctcaggtgagtggggcggggagaggcccggcgcctagaggggccgagccacgagcgccaggatggagccaggcggaggcgtagcctctggaggctggggaagtgggaattccgggggcggaagtggcggggacccttggagcctagggtgtggggtccaatgtgctggaggtggagagaccactgatggctgcaatttgggaggattctgtgctgaacgcggacactccgtggctgcagtgggctgggggtgggggctgctctgcctcgacctcggaagctccgagacgctcagctgtgcggcgtcccctagggctgagatctgagggccccgacgccaagggttagggagctctcgtactcccaggggtcagggactcctggtctggaagaaggagtctctgggggctgtaaggggactcctagggccagagactgagaattccttggggttaaggtttggagcaggaggtgggcatcctctggggctggcgctacgccccaccctcgactgtcccgggcctcccctcccaggcacaggagcagagaagactggcgtgtgccccgagctccaggctgaccagaactgcacgcaagagtgcgtctcggacagcgaatgcgccgacaacctcaagtgctgcagcgcgggctgtgccaccttctgctctctgcccaatggtaaccccacggcggccgagcgggaacggggcggggccgcgctgggctgggaggaggtgggagggcccgggttccgggaacaggggcgcccccggacccggggacccccgggaaagtcaaggcggttgaaaccagatccgtcagtcctctccctcgcacggcccaggggtagacaaaggcgtcgttgaaacgcagccaagggggggtccccacccctagctgggattcgagtctctggtgcatgacgggcttccgggcacgcacagccgggacattgttccccgcggcctggggacccggggccgcagtttccttctcgaaccggccgaagcctgccctgcgggaaagcccggagcctggggcgctcacctctcctcttggagtccctccctgggggcctcccccagccctggggaaagactgggagagcctggcctggcaagattttccccaattcctctgtccaggcggaaaggaactttacagatttaggaaaatgccccgctcatcttaaagatgtgtaagggagcatcggtgagaaaaaaatgttcttgcccaaggtcacaccgccatcccatggctgctggagtcatagtgagggttcagcttttgcctttcaggccaactggctgagtgattcgaagaaagtgaggaatcctccctggacactgtatcgcccttcgtcgtctttcagtcaatctcttccactctaaggattgagtgagcgcgagctggggactctctcaaaggtgcttgctggagctgcagtctccaccaggctatcagaacagggggtggcttaaacagcatggaatctcagctttccgttctccagaggaaaatgctgaggattagaggcagggataggacctggagagaaccaaggtactgtaatgatgttctttatccagaatacagcccctgtgacttttcctctctgttatttccttgaagatgccagcacaggctgggaaggtttgtaatacggtgacccaagacaccgatcagcagggaggtggtaagtggagggggactggcagcccaccaagggcagcttcaaggtcatgagtcccctcctctgggccagggagaggaggaccagaaggagagaggaagatttggagagaaagcaggcagcagccagatgagagaggtggaggagcaaaggagggagtctttgctgtttgatggatgaagaatttgttcccttatctcagatggacagactgaggcaggaagagggacaaggtcagatggcctcctgagccagggaggcagcctggaggtttgaatcctagttctgccattttctagttatgtgatcctgagcatgttgtttacctctctgagcctctgctctaagatgggaataattccaaactctataggattggcatgaggactaaatgaaataatgcatctaaagtgtctattagtgagaagatactccatacacagtggcttgttttgatcataaatggttccctatttatttccagggcagcccaatattacaggttcctactcctttcaagagaatgaatttctttgtattaggaagtcaagactgttggcaacttaacaacatttttttttgtatttatgctttaagttctggggtacacgtgcagaacgtgcaggtttgttacataggtatacatgtgccatggtggtttgcttcacccatcaacccgtcatctacattaggtgtttctcctaatgctatgcctcccctaattcccaaccccccgacaggccctggtgtgtgatgttcccctccctgtgtccatgtgttctcattgttcaactcctacttatgagtgagaacatgcggtatttggttttctgttcttgtgttagtttgctgagaatgatggtttccagcttcatccatgtctctgcaaaggacatgaactcatcatttgttatggctgcatagtattccatggtgtagacgtgccacatttcctttatccagtccatcactgatgggcatttgggttggttccaagtctttgctattgtgaacagtgctgcaataaacctatgtgtgcatgtgtcttgggcatttgcgttggttccaagtctttgctattgtgaacagtgctgcaataaacctatgtgtgcatgtgtctttattgtagaatgatttataatcctttgggtatatacccagtaatgggattgctgggtcaaatggtatttcttgttctagatccttgaggaatggccacactctcttccacaatggttgaactaatttacactcccacgaacagtgtaaaagcattcctatttctccacatcctctccagcatctgttgtttcctgactttttaaggatctccattctaactggtgtgagatgttatctcattgtggttttgatttgcatttctctaatgaccagtgatgatgagcatttttcatgtttgttggctgcataaatgtcttcttttgagaagcatctgttcatatccttcgcccacgttctaatggggtttttttctcgtaaatttgtttgagttcttgtagattctgtatattagccctttgtcagatggatagagtgcaaaaattttctcccattctgtaggctgcctgttcactctgatgatagtttcttttgctgtgcagaagctctgtagtttaattggatcccatttgtcaattttggcttttgttgccattgcttttggtgttttagtcatgaagtctttgcccatgcctatgtcctgaatggtattgcctaggttttcttctagggtttttatggttttaggtcttacatttaagtctttaatccatcttgagttaatttttgcataaggtgtaaggaaaggggtccagtttcagttttctgcatatggctagccagttttcccaacaccatttattaaatagggaatcctttccccattgcttgtttttgccatgtttgtcaaagatcaggtggctgtagatgtgtagtgttatttctgaggcctctgttctgttctgttggtctatatatctgttttggtaccagtaccatgctgttttggttactgtagccttgtagtatagcttgaagtcagttagcgtgatgcttccagctttgttctttttgcttaggattgtcttggctatgtgggcttttatttggttccatatgaaatttaaagtcgttttttctaattctgtgaagaaagtcagtgatagcttgatggggatagcattgaatctataaattactttgggcagtatagccattttcacgatattgattcttcttatccatgagcatggattgtttttccatttgtttgtatcctctcttatttcgttgagcagtggtttgtagttctccttgaagaggtccttcacctcccttgtaagttgtattcctaggtattttattctctttgtagcaattgtgaatgggaattcactcatgatttggctctctgtctattattggtgtataggaatacttgtgatttttgtacattgatttgtatcctgagactttactgcagtttcttatcagcttaaggagattttgggctgagataatggggttttctaaatatacaatcatttcatctgcaaacagggacaatttgacttcctcttttcctaattgaataccctttatttctttctcttgactgattgccctggccagaatttctaatgctatgttgaataggggtggtgagagagagcatgcttgtcttgtgccggttttcaaagggaatgcttccagcttttgcccattcagtatgatattggctgtgggtttgtcataaatagctcttgttactttgagataccttccatcaatacctagtttattgagtgttttagcatgaagggtgttgaattttatcaaaggccttttctgcatctattgagataatcatgtggtttttgtcattgattttgcttatgtgatggattacgtttattgatttgtgtatgttgaaccagccttgcatcccagggacaaagccaacttgatcatggtggataagctttttgatgtgctgctggatttggtttgccagcattttattaaggattttcgcactgatgttcatcagggatattaacctgaaatttttttgttattgtgtctctgccaggttttagtatcaggatgatgctggcctcataaaatgaattagggaggaggctctctttttctattgtttggaatagtttcagaaggaatggtaccagcaactcctctttgtacctctggtggaattcggctgtgaatctgtctggtcccagactttttttggttggtaggctattaattactgcctcaattttggaacttgttattggtcgattcagggattcgacttcttcctggtttagacttgggagggtgtatgtgtccaggaatttatccatttcttctaggttttctagtttatttgcgtagaggtgtttatagtattctctgatggtagattgtatttctgtgggatcagtggtgatatcccctttgtcattttttattgtgtctatttgattcttctctcttttctttattagtatggctagcagtcagactattttgttgatgtttttcaaaaacccagcttgtgaattcattgattttttttgaagggtttttcatgtctctatctcctttagttctctctgatcttagttatttcttgtcttctgctagcttttgaatttgtttgttcttgcttttctagttcttttaattgtgatgttagggtgtcaattttggatctttcctgctttcccttgtgggcatttagtgctataaatttccttctaagcactgctttagctgtgtctcagagattctggtatgttatgtctttgttctcattggtttcaaagaacttatttatttctgccttgattttgttatttacctagtagtcattcaggagcaggttgttcagtttccatgtaaggttatgcggtcttgagtgagtttcttaatcctgaattctaatttgatggcactgtggtctgagagactgttaggatttccgttcttttgcatttgctaattagtgttttacttccaattatgtggtcagttttagaataagtgtgatgtggtgctgaggagaatgtatattctgttgatttggggtggagagttctgtagatgtctattaggtctgcttggtccagagctgagttcaagtcttggatatctttgttaattttccgtctcattgatctgtctaatattgacagtgggggttaaagtttcccactattattatgtcggagtctaagtctctttgtaggtctctaagaacttgctttatgaatcagggtgctcctgtattaggtgcatatatatttagcataattagctcttcttgttgcattgatccctttaccattgtgtaatgcccttctttgtctcttttgatctttgttggtttaaagtctgttttatcagagaatagaattgcaacccctgatttttttttgctttccatttgcttggtaaatattcctctatccctttattttgagcctatgtgtctttgcacttgagatgggtctcctgaatacagcacaccaatgggtcttgactctttatccaatttgccagtctttgtcttttaactggggcatttagcctgtttacatttaaggttaatattgttatgtgtgagtttgatcctgtcattatgatgctagctggttattttgtctattagttgatgcagtttcttcatagtgtcgatggtctttacaatttggtatgtttttgcagttgctgattccagttgttcctttctatgtttagtgctcctttcaggagaccttgtaaggcaggcctgttgatgagaaaaatccctcagcatttgtttgtctataaaggattttatttctccttcatgtatgaagcttactttggctggatatgaaattctgggttgaaaattctttaagaatattgaatattggcccccactgtcttctggtttgcagggtttctgcagagagatctgcagttagtctgaagggcctcccatagtgggtaacccaacctttctctctgggtgcccttaacatttttttcttcatttcaaccttggtgaatctgatgattatgtgtcttggggttattcttctcaaggagtatctttgaggtgttctctgtatttcctgaatttgaatgttggcctttcttgctaggttggggaagttctcctgtataatatcctgaacagtgttttccaacttggttccattctccccatcactttcaggtacatcaatcaaacataggtttggtcttttcacatagtcccatattttttggaggctttgttcattcattccttttcattattttttctctaatctcatcttcattctttatttcattaaattgatcttcaatctctgatatccttcttctgcttgatcaattcggctattgatacttgtataggcttcatgacgttctcgtgctgtgtttttcagctccatcaggtcatttatgttcttctctaaactggttaatctagttagcaattcctataaccttttttcaaggttcttacctttcttgcattggggttagaacatgctcctttagcttggaggagtttgttattacccaccttctgaagcctacttctgtcaatttgtcaaactcattctccgtccagttttgttcccttgctggcgaggaattgtgatcctttggagaagaggtgttctggtttttggaattttcagcctttttgtgctggtttctccccatcttcgtggatttatctacctttggtctttgatgttgatgatctttggatgggccttctgagtggacgtcctttttgttgatgttgatgctattcctttctgttagttttccttctaacaatcaggcccctcagctgcaggtctgttggcgtttgctggaggtccactccagaccctgtttgcctggctatcaccagcagaggctgcagaacagcaaagattgctgcctgttccttcctctagaagctttgtcccagaggggcacccgccagatgccagccagagctctcctgtatgaggtgtctgtcagcccctgctggaaggtgtctcccagtcaggagacacggaaatcagggactcacttgaggaggcagtctgacccttagcagagctcaaatgctgtgctgggagatctgctgctctcttcagaaccggcaggcaggctgaagccacatccacagctgccccttcccccaggtgctctgtcccagggagatgggagttttacctataagcccctgactagggctgctgcctttttttcagagatgccctgcccagagaggaggaatctagagaggcagtctggctacagcggctttgccgagctgtgttgggctctgcccagtttgaacttcctggtggctttgtttactctgtgaggggaaaactgcctactcaagcctcagtaatggtggacgcccctccccctaccaagcttgagagttccaggtcaacttcagactgctgtgctggcagtgagaatttcaagccagtggatgttagcttgctgggctccatgggggtgggatccgctgagctagaccacttgtctccctagcttcagccccctttccaggggcgtgaatggttctgtctcactggcattccaggcaccactggggtatgaaaaaaaaatcctgcagctagctcagtgtctgcccaaatggccacctagttttgtgcttgaaacccagggccctggtggtgtaggcacccaaaggaatctcttggtctgtgggttgtgaagaccgtgggaaaagtgtagtatctgctccagagtgcactattcctcacggcacagtccctcatggcttcccttggctaggggagggagttccctgacctcttgtgcttcccaggtgagatgatgccctaccctacttctgctcgccctccgtgggctgcacccactgtctaaccagtcccaatgagatgagccacgtacctcatttgaaaatgcagaaatcacctgccttctgcattgattcactgggagctgcagactggagctgttactattcggccatcttgaaagctgaacctaaatcttttttttttttgagatggagtctcgctctgtcgcccaggctggagtg[137 bp omitted]gggggtctcgagtcctgacctccgatgatcccacccgcctgagcctcccaaagtgtgggattacaggcatgagccactgcacccggtgatctgtcagccactttccttgtcctctacagctaatcacccagttctgtgcctgtgttttacacacaaaaacctgcacatatttatagcagctttatttataattgccaaaagttggaagcaaccatgatgtacctcagttgatgaatggatttggctgggcctggctcccctctatctaacctgggaagtggagtgtgattgtgtgtgtgtttgttagtggaaggacgtgtggtttctctctgcatggatgaatgagtgtatttggagggtcatggtgctgagagactgcaactgggattcggtctgtgggtatgagtgaagattataagtgtgtaacccctcacatgtgtactgtactttacactttaagtggcagcatagtgcttaaccatggcagcagcagttaacacatagactctgcagctagatttcttggggttcaaattctgcctcaattctgtgtgaccttaggcaaattacttaacttctcagtgcctcagtttcctcacttgtaacacaaggaaatattaacagatccctccccttcttttaggattattgtgagaattagaagagttaatatatgttaggggcttgatacctggcatgtaataagagctaattaagtgttcactgttataatttctcataactacagagtagtttgatatttcagggagaaataatatatgtttgtttcccactgctttcacaacaaccctatgttgtaattagcactgttccactggcacctaaagacacggaggctctgggagatttctggccctaggccacgaaggcccacttgggactcaagctgaggtcctgtgattccatttgggagcaggaggagggatttgcaggtgatcttcctgggcctcctgagagcagctcaggtgcccaagatggactcaggcaggcagctctgctgtatgtgaagcccagtgaggggcagtgggggggccatgctgcaggtacaagttaatctccctgtatcgcctctgcccacttacccttactcctttttctacccagataaggagggttcctgcccccaggtgaacattaactttccccagctcggcctctgtcgggaccagtgccaggtggacagccagtgtcctggccagatgaaatgctgccgcaatggctgtgggaaggtgtcctgtgtcactcccaatttctgaggtaagtgaacgggaaagagaaagtgcattgatggccaggtgttgtgggaaacaggagaaaacgtcacccaggcggaggtgaagggaggttagttgcagggacagttgggaaaggtataccagtggggtgaccctcagcctgttctaaaagaagagtgaaaggtgggtagtctgatgagctgcattggggaggctgtctcaggcagagggaacagaataagcaagagcttggctgggtgtggtggctcatgcctataatcccagcactttgggaggctgaggtgtgcggatcacctgaggtcgggagttcaagaccagcctgaccaacatggagaaaccccgtctctactaaaaataccaaaaaaaaaaaaaaaaatttaatgggtgtggtggcgggtgccacccacccgctactcaggaggctgaggcaggagaattgcttgaacctgggagacagaggttgtggtgagctgagatcacgccattgcactccagcctgggcaacaagagcgaaactccatctcaaattaaaaacaaacaaacaaaaaacagcttggtggtacccttgggttgaaatctcgtggttgtcatgtgctacttttaacaatttctcagcaaagtaacctgaagataactgatagaatccaatagtgcagagatgagcaattgaaatctagagagggggtgtgctcttggtgcccgagagggaactatggtttctctaaactaagctatggtctccctggagccagggctctcagatgccaactgcatggataggctttgcagtcaagaagaccttggttcaaatgttagctctgacacttacctaaccttctcacctccctgagtcacagttatctcgcttataaaatgtagctaaataagatctaattgatcagataatcccattttaacctaaagaagaaggcatggcagaacttcctaatagtagaaggattcttggggagagaaatggccatgacccctcaggaaggccacagtggacatctgggaccacagtatacccaggtgcctgctagggatggtctgaccacagtatacccaggtacctgctagggatggtctgaaggagaagagtatgtctagaacctgtagaaaatgcaagcagagcccccagaaggtgaggctttgctgtgtgggtgtgtgggatggggtggggtcaaggagctggtctaggatttaagctgcaggtactcctgcctagtctaatggatattgttgttgatggtattgttataattttcttcctccagctccagccaccaccaggctgagcagtgaggagagaaagtttctgcctggccctgcatctggttccagcccacctgccctcccctttttcgggactctgtattccctcttgggctgaccacagcttctccctttcccaaccaataaagtaaccactttcagcacgttctgtctctgtctcccctgacttgggttgaggtgggtgggcaagtgttaagggtgtgaccagatcatccaggcatgaagtccagagaaggatcatctggtaggtgttagcattctcctggtggatccctgcatcaaccctatgaatctggtcattattcctccaggaggatggatgagaaaaacgaggctcagacaggtggtggggtgcttccaaagtcactcagattcattgctgggggtgctgataagcagcagcatgcaccaggtgccagacacggtgctgggaggtttgcttatgagatcctctgggtcctcaaaacaatccccagagcagttaacaacatacccctgtcatagacctggactccatgaggttacttgccagtggccacacagaaagatggcaatccaggatcctctcttgttgatactttaagtcaaagttttattttatataagtaatatagtcatatgcatccaaactcaaaagattaaaaaaagatatacaatgaaaagtgtctttcaccctttatcccctgtctccaccttccaccccagccaccaagttgttttctataaagacaaaaaatgttctcagtttcttgggtttcttttcagatatgtatccccagctctcaatcctttctctctcccttctctatttcttcctcttttcctttctattccccctctatgcctcactctattctctttctctctcctctattccttcctctccatcctccccctctccatactccctctcttaatgcccctctctctatgtactttcctctctctccatagtgtccccttctacttctctccccactccctatctctatcatctctttccatctgttagagtaggtagttagacatgagcaggacaggagagggctcccccctcacacgcccaggaatgtcaggtgacgatcaggtgatggtcaggtagtggttaaactgtctctctaaaatgatcactgggccgggtgcagtggctcacgcctgtaatcccagcactttgggaggccgaggcgggtggctcacctgagatcaggagtttgagaccagcctggccaacatggcca[140 bp omitted]cactccagcctgggcaacagagagagactgcatcttatttttattttttaaagttacaaataaaagttttcttggctctgaaaaacaaagatcagcaatgttttaagtaaaaagtcatagaagggttattttagtcttctattagttcagtctatgcagttaacacctgttctgcttgatattcataaacatttcagctctccatgagagtcctgaaagttttttcctcgattctaatgtcacaatctccaaaggtatcagaaacctgcattcaagagcacctgtcaaagtcctatagctgattataaaccaccttttgaagagaatcaaaacaagacaataattgtgggtgacaaaaagtcttaggacagccactactaaagccacatttgacaattttggttacttctgtggcatacaattttacacaacaattataattattaattacatacactaagccatatcagaattacaggactttccagtaattttggaacatatactaataacatatttatacaaatacagcccaaagaaagccaaacaccatttcatatttgacaatgcttcctgtatgatttttataccaaataagccaaatatgtcatttttggactttaggggacctaatagctataagattaattaggtcagaaaaagacataatttataatttggttttggaaagtttgttactatcaaaggtttaaaacacttgatattatagaagagaatcataggccaccataagtcatctagccaaaataactcaaaaattttaaaaaggcaaaaaactttattcatggaaaatcttgttcaagagaaagccaaatttcacctttgcattagtgtactattaatatcaaacccaattcttagtagaaccttagacaaatctcttcaattttaatgtttgaccctaaggtaagattcttataaatcttatgaccctttacaatttttgttaaagagcagatcagtgctccaaggaaatccttttgtgcttttattccaatgttcaatttacagaaaaactgaataatgtcactttagctttagccaatatgttcacatataaaatttcttttaccagattaatctttcacaaacctatcacaacttgctcaaaccttcagctttatgctatcttagttaaaacctttaaccctctaaactagtgtagccaaaaaactcccacatttccatgccttcttataatcttttaccaaaaacacatttcactttcctgacacaccttgcatgtaaaacgtttctgtagtagtctccattgcatgttacactgttaactcttagaaacttttgttgttgctgaaaaacctgataagtgagtgatttttaattttgtagcaggtgtggagcctaagatacgagacaaaaatgcagataagttatccttccatcatagtgagggggcatccctaactccgcatgtccacaggccttacctagaatctaatagctcaaagaatagctcttctttgacttttcaaaagtcaaagaagcagttcatgatcttaaagcgtttagcaaacctaattatctgacctaatttagaccaaatgtctttattttaccaataattttttaaactgtccttccaaagcttactaaagtcacgtgaactaaaaggcattagtttttattttcctgacaaaatatttaagcgcttatttttaagccaattaatcagagctccttcatatataaatgtcacacacacaacacatataaatatacagacagcagaagatccagtagttgttacgatttttcatttggcagtttttaagtttcttaattggattactggcttcagggtggggtcctttgaggaacagggttaggaaaacatgccgtttctagggcttaataagcagatacagatggaaagcaaaacagatcccccaaaattcagggtcctatttttataccggatcctcaattcccaaaaaagaaatactacagaacaagacaatgaatgatcttactgtgagtttcattgcaagacaacccagagtcaatcagcccattctgtgatcagcctatcccccacggaagccttatctcagtggtggggtgggggatggggatgtttccataccttccaggtggctgagagcacgcctctctgatccaaacgtgcagagagccaagtatcccgccataactgccactggccatgcccaaaagtatatttgctacctagttattacacaccaaagctcactcataatgtgaagtaatttctgatactctaaaaagtaaaaaatgtcaaataacgcaatgcaaaacagaacagagccttagcttttgagagagatctatctgcttccaatccctgggtcttaatgaggaaaacagatgttttccctaaaacggggtctgtggcacctcctctgtttttctcaaggagtccaaggctattagaaattatcttaggtcctctcacatgtgcatcaagagtggcaagaaggcaaaacagagaaacaattcagttgactgtgaaaaaaaaaataccttttttttccccttgtcttgttttcccctggtaaaaaaaaatacttttttcttcataagatccaagaagagaaaaaaacataaagaccttttaaatatacgtatagcttggatatctgcttttaattaagctaacttttaacaaaatctcttattaccagactctagccgggacaaacagccaatatttatggcctttaaactttaccaaaggtaatctcccaggtgaaaccaataagccttaactaaggttgtgacttaaccacaggtgtacgaagtattttcaaacaggtggtaagcagtttttacaagatttagaatctacaaaggcagcttagagaagggaaaattcaaaaaggaaagccagatgttgttcaaggaggggcagagaatcaacaaatggcaaagctcacgtagatatcaaactagaaaggactaattccctgagctgggaattgaaccctgaatgtgggctgccattgtgaaaagacaaaaccttagctactaagcttcagcattgggcagtttccatttcttttcttagaaggaccctagaggcagccaattttgagcttgcaaaggcttttaactgctcaagacaatttttagggctatgacgtgaacctcaaaattcctgtcctctggatgctggagactaagaaggtataccaccatatggttacaaggtcaagcttccaagggcataagacaaggggaaaacttcagtcagttttttgtttgtttcagggacctgccgcaaagtttgtaactgaccagtgtgccggactggcttgaacagcaagcttaccgggtcctaagcccatattctatcctaaggtacctctctttatgacagaaaaatacagaaagacaaattcatagcacaaattacaccagatttgctacagcttaatactagccacatgaaggcttttgtttcattaattgaaactttgcagaggaggcagtgatttttaccattcctacagtcggcgcgcacagagagaggccagaagtctgactggtaagaaattcttacccttttgctggcatgccaggtttctgggttccctttccctgagtggccctagcgaatctacttgctgcatcatagccctggaggccaagctgcaacacaaaattaaaaaaaaaaaaatctcaattttgtaagatgctgcccagtgggttgcatggggtaaccaaatgaacattttccattccagccagagcaaaatacgtgtgacaaaacatagacattagccgctctgcttagcacccaatatctaactggcaaggctcaaacttgcccccggttgggccttgtcatctttaatccattcaaagtggggtggagtgacctccgacccggaatttcaacatgtggtctctgggcaagatggaagagcaggtagtctcaagtaacagaaacgataggaaaagaaaaggagagaaagagagagtaagagagagaagcctggtctgaggcagggtggggaagcggggagctcagggagaccagaggaatacccacccattgcagcaacactgaatcaaaagttcaggcaggtacttgtcagtcacaaagggatcttttccagcagtcccatcagctctcaagttgccccctctggggagaaaaaagttccccatgttccaagatcctgtacatgcctaatccagtcacctgtagccatcagcaaacagtgcaaggcagattaatccagagaatagcagttaacatttcatagtgccaaatccatttctaaccaagagggatgttactgagggggacctctgacccactgtctttctcttttctttctaaccactgtctttctcttttctttctttttttctctttctctctttcttctttttgagatggagttttttgctgtgttgcccaggctggagttgtgcttcatcctaaggtacccctttttatgacagaaaaatacagaaagaaaaatttacaaaatacagaaagagccccctctgctggagaagaaatctccacccactccacctccagccccgactcctcagcctctcccacccgctccgccgccacagccagccctgccctcaccacccccgctggtggcccccacgtccagctcaccaccgccaccaccgctgccacctccaccagctatgccttcgcctccactgccacccccgccagccgctgccccaccggctgcccctccaggggagcccgccccccatcccccgaggacgctgagctgccggacacctggcctctgcacctggccaagaagcaggagacggcggccgtgtgtggagagacggactagaaggctgacgagagtggcggagagggcattttccgtgagcaggacgagttcgtcatccgcgcagaggacatcctttccctcaaggtgagtcccaggcttctccaaaaactgggcctgatgggttacttgagtgtttgttgagcgcctgctggatgagaggcttgtgttgggacctgcggatccagtcatggctgagggagaatggctgggcccactggaattcacagtccaatggggccgttagaggtggcagtgacctgcgggcctcagaggtgttatttgcgtatgtgtttatacacgcattacctgtatgtaaggtaaatacttttttttttttttgagacagagtctcgctctgtcgcccaggctggagtgcagtggcgcagtctcggctcactgcaacctccgcctcccgggttcacgtcattctcctgcctcagcctccagagtaactgggactacaggtgcccaccaccacgcccggctaattttttgtatttttagtagagacggggtttcacggtgttagccaggatggtcttgatctcctgacgcaccgccttggcctcccaatgtgctgggattataggcgtgagccaccgcgccggccaggatttttgtttgtttgtttgtttgtttgtttgtgatggagtttcactctgtcgcccaggctggagtgcagtggtgcgatctcggctcactacaacctctgcctcccaggttcaagcaattctcctgcctcagcctcccgagtagctgggattacaggcacataccaccacacccggctaattttgtatttttagtagaggtggggttaccatgttggccaggctggtctcgaactcctgacctcaggtgatccacccgcctcggcctcccaaagtgctgggattacaggcatgagccaccgcgcccagccaccccctatggcttagaagggactctaatttttctaagttaagcctttaacccaggtttggtcaagcgtcgttgctttttattaacaggggcctttaagcctctttgtcttaggagggactctaactctcctaagttgggcttctaacccaatcccatcctttacccaggtaaaacgtaccccaccacatatccagagttggccaattggtgctgcagtctttttctttgggtcagaagtctcttcagtatagtcgcttcatggtggccaggaagatgttaccagaaaggagtccggatccagaccccaagagagggttctcagatctcacacaagaaagaaatcaaagcaagtccgtagagtaaagtgagaaagcaagtttattaagaaagtaaaggaaagggaaaaagagtggctactccatgggcagagcagccccaagggttgctggttcaagatttttatggttatttcttgattatatgctaaaacgggtggattattcatgagttttcatggagaggggaagagatttcccagaactgaggatccctcccctttttagtctatataggataacttctgagtgttgccatggtgtttgtaaattgtcatggcactgataggagtgtcttttagcatgctaatgcattatgattagcatagaataagcattgaggatgaccagaggtcactttcattgccatcttggtttcagtgggtttcggctgggttctttaccacatcctgatttattagcagggtctgtgacctgtatcttgtgccaacctcctatctcatcctgtgactaagaatgcctaaccctctgggaatgtagccaagcaggtctcacccttattttatccagcccctattcaagatggagtcactctggttggaaggcctctgacacaatgatttcttactttaatcctggggtgtatgcttatcctttggggtgagggagaaggagaataagggagtaatgtcagtgactctggccccccaggaacagccttcatgtccttcccttctctacccaccgtggaacatgagagatctggaaagtttcagtgacattgtctggaatatctggccagcctggcttggtgtctatcaggctttatcttcctcatcttcttgtgggaccagggaccagggaccagacaaggccccagggcatctccattcactcccaggggcacaaactgatagagcctcctggtgggagtggggatgctttgtgcatatgatagccccttggccagagatggcagtgtagattttcccagctccccactttctgatttctatttttgtccatgctcggggctccccaaccttttaggcagaaacagaggcatccagtgatgggttgggaagagttgctgggaactcggtgtgtgactaccactagctccactttctcctgtccttctacaggtttgcattctgaaagagtggcccaggcagggtgatgtctaacccagggatggcaaaggtgtccacatgccatcatttcttccaccagcacccatatcacatgattgctgctcctttccattagcccatgtgtggccacagagccctcagcacagggctccaggcagctgctacagctgcccattgattggggttgatagatagatttgctacccctgatttaactcaagaaataaaatgctaatggtgaaaagtcagacctggcagttgaggttttactgagtaagaagactgcacaggggaccctgagcaggggtccaaaggagatgggacctcaggccctccaccagaagcttaagagggggtaaagctttttcaaggggtccctagcccagaggcctcctgcagaagatgaggtggaagttgccagggatctcagtaatgcacaggaagaagctaccagggaaggaggactgagaggtgggatggggcaggtaagaaagcaggggtgggttagacgaggcagaacctctggctgagacccttcctttaattttcttttttaagctgcttggtcaataagtttattgtttttatctgaataatcttatagaaaatgactatttgccagacgtggtggaacgtgcctatattcctaagtacttggaaggccaagtgggggaggattgcttgagcccaggagttggaggctacagtgagctatgattgtgccactgcactctgacttgggtgacagagcgagactctgtctctgaaaaaaaaaaagaaaaaggaaaaagaaaagacaagaaaatagttgtttggcttagcgctcagcagcctgctcctgagctcttagaaaacttgccttctgagctactcagtctttcttctggacaggggacgtcttgggatggttccaccttttcttaacttcttccccaggcttcctctcgtgaactggattctcttgttcagcatcatgagctttcttacatgtctctccgtcatgactggagttatgttgttctttatgtattgagaaaattgtttcttgtaaacatcttcatcttcttacattgggtaatgcatataatctgcgatcttctgacccaggatgtgcttctgcattgaactccctgctttctgaattggaaccagggaattgtttggtaactgtgagggatagaaaacctcaatccacacctcccttcagggcccccctacctttatttccgttggtagttctggcaagtagcaagtgaaggcaccaagtaaccatcaatgcttcccatgtgatacccatctctgctcacctccacttgaccttcataggtgttgtccatgccaagactattgaggggccttcgggtcagcacaggccagtacaatgtgctgcatcataatctggctggccaaccttcatgctacactttagacattcatgaacatatgctgtgcagacaatcatattcccttctgtgtgggcaaaaaccatatgacaaatgatctctctgttagttgcatgaactatcctgaattttggtgtgttctacttattttcatcctggattaccaagtgtgtctgagcatagtaatcagtttaacccactggtcttctaaatgtcatctgtatctcttaaagtaggccttactcttaacaattttaacacactccatcctccggaacagagagctgtgtccatggcttgacacagacctgcagcgtgcaaggggggccaggcaaggcggaagccctacgatcattctttgatcaacttttgcagccaagtgaatgctgtaggttggggactctgaagatttgtgattggaaagggggaaggaaaaaggacagggtcccagactggtctcttccccctcttccaggccttgatgggccacacttgatataggcagaccacagcaaagcttagttttggccaggagaacagctcccagggcccaggaatcccagtaaacaggtggatcgagatgggacagccaacctcaaggcccctcacagaaccactcagcccagctgcccctccagacgtcagggcagggcttcttcccgcacttattttctcccatttccgatggcaaactgctttgcagatgcctctaaaggccatccccagcccaggaagccatgtatggtaatacctacatggaaacagacatcttctctgcaggaaagtgcaggtttggggttggagcgatagtaagaagttacatgagtgagctggagcttagaaaataaagttctaaagacagaccagtcagggaggggaaggtcctgccccagaaacaacatcagcagaggcattcactcattcaatatttataaagcacttactatgtgttctattctaggtggtggggatttgatagaaggaaaagagtgtgtgtgtgtgtgtgtgtgtgtgtgtgtgtgcggtggagaggatagccaataaataaatgaactaacacatatataacatgttaggtggaggaaaagttatggagaaatacacaggtaagaggaatagtgagtctgggggtggggtagagatgggggtgattactttgcaaagtagtcagggaaggtcttaaagtattattcaagtagtgaactcagtgaaggaggacatgagctgcgtgacaacccatgagaagaggaatttagagagaagagagttccagaacaaaggacctgaggtcagagtgttctcagggtgttggggatcatccaggaggctggcatggctggggtgaatgagtggtcaggagcctgaggtgagttgaagtcagagaggtagcatgggcacagagaataagggccttgtggctcattgcaaggattttgccttttatttggagcaaatttgggagccactggaggagtttgagcagaagagtgacatatgacttcagttggaaaaggatccttctggctgctgtgttgtgaatactacaggggagatgcagaaccagggagggcaggtaggtcactgcaacagggcaggcaaaagctggcttaaaaaaatgcttcaggctgggcatgggggctcacacctgtaatcccagcactttgggaggccaaggctggcagatcacgaggtcaggagctcgagaccagcctggccaacatggtgaaaccccgtctctactaaaatacaaaaaaattagctgggtgtggtggtgcgtgcctgtaatcccagctacctgggaggctgaggcaggagaattgcttgaacccgggaggcagaggttgcagtgagccaagatggcgccactgcactccagcctgggggacagagcgagactccgtctcaaaaaacaaacaacaaaaaactcttcatccagtggtatgaggccccccacactgtcaggtagaaatcttggcttccttaaacaaacctttattgtttcccttattggaagtattccttccttggtttctaaaacaccgcagagccctgagacacaacatttaacataatcatagtaatgctgaattacaagccaactcaaaattcagtgacttaaggcaacaatcattcgctctcactcccatatctgtgggtctgctggggttcagctgatctaggctgggctcagctggttcttcttgaaccagcaggttccataaaatgtattccctgggtcacctgaggtcaggagttccagaccagcctggccaacatggtgaaaccctgtctttactaaaaatatgaaaaaaattagccaagaatggtggcggacgcctgtaatcccagttactcaggaggctgagggaggagaatcacttgaacccaggaggcggaaattgcagtgagtggagatcaagccattgcactccagcctgggtgacaagagtgaaactcggtctcaggctgggcgcagtagctcacgcctataatctcagcactttgggaggccgaggcaggtgggtcacgaggtcagaagttcgagaccagcctggccaagatggtgaaaccccatctgtactaaaaa[131 bp omitted]tgggtgacagagcaagactctgtctcaaaaaaaaaaaaaaaaaaaaaaaaaagcaaaacttggtctcaaaacaaaacaaaaacacattctcgtaggattggtagaaggataagcacagattccaagtctgtgctttcatcatgtctgttagcatcattagccaaaataagtcacataccaaccccgaagttaaggggcagagaaatatactctgcctctagtggaagaaactgcagactctttgattgtggatatagggagggtgatgaattggagccagtaactcaatctaccacagttattatgtttaataacaagatatgctttggttgctctgatccatttattctggctgtgggaaaaaaagcaccatatgctggttgctgattgagagcatgtacagtatcctgcgagatagaaccttacccactcgaagttttatttccaagttgttaatgtcacacctgcaggacatcccaccattccacaagtctggctgcttctgggtgatggagaacaggataaaactggtgaatcccatgaataacaggccctttctttctttattttactgtagcactctccctagatgtctgtatggttaatcttcactcacctcattcaagactttgcttaagtgtaaccttctcaaaaaggcccactatgaccatcctcattaaaactgcaacctctgcatccccagttccccttattctactcactttttccccatagcaccttgtactactattagtctatataattaaattatatattatgcttattgtttattttctgggccccaccctgaatataatatttattatctttgccccactcagagtgtttgtgatcaagaaggggaaaggaaaagattattgttttgtccgttttgtgtttggcatatagtaggcactcaataaatatatgttaattgaatgaatgaatgaggagttcttttctagaagcaatattatatgggatacagtcactgtgattaagaaattccacaaatccatgggtaccagtactggcacaggcatggaaggcaaggaaataaaattcaaattcagaatatctattccagtgagggccaatcacccctgcctccatgcttttgaaggggtctcatgtacctgtcaccagatagctggttcattttctctggttaacggcaccatatcagggcttagattggccatcacgctagcaggctcactgctggagtacactgctgtataccataagtgtcaataggccaatcagccttgctaagtgggaagtccatgtcattggccccaggcttagtccctaccactgtcacatggtgctttgttcatgagccccctgagcaagcactagggtggccagggagacaggctgactgacatctatgggggtgtcatcctctctaagtgattacaagagcttctcttgtagcttttgtgaagtgcctgcgggacattgagggaggtcttggcccatctcctgggctcagttcctctttggctttgaagcccagtaaatagctaattctatatgttgtcatactgggtactggccattattacattgtcacaatgggactgtgcaagtgtgctgtctcagtttcacatagcttctgcaggaagatggtactaattgtgtagtaagaaactgtgtttataacctggatattagatcaagatggtgaagattgcttcacatttttacaacatatcagggtgatatgttgcaaatgtaagaaacttggtaaaccccatgtgggatttcctctatctagtaggcttgcaccaacccaaaatattccttgtgaggaaactggaaggttacagaagcaacactcattgaaaatccccccaatcttatgtcctctgtaatgcttttctgaaaatgcatcatctgatcatattgcagtaaatgcaactgctatatgatttaaacgttcatttctctaagcctcaaacccggtccaattccatttatgtagtgtccaacctagggcttggtttaagtgaggagaggtcaagagtaagacaagatctcttccggattttgaggtgtcctaacacccattatttgcaaatgagcttaagtcctttcagggaccaccccagcagaacatggtgtccagaagagtcagaggagctaattattggattcaatcacagaccagtgcagggatcttggagtccaaaatacactcttcttgggcagggaaggggagaggctgcccgctactgtaactggcaaaagggtttggctgcttgccacttgtaaaaagaagccagtataatgagaatgaagtgtgataaaaagagagcaagattttattatccatgctagatagaggagaagtggatgtaattctttccaaagatttccactttatgatttgtagaggaaacacggggtcttttaaagacagggttcagaatgcagaagaggcagggggctaggaggtgtcaggtggggtgagccactccaatgggttgtcttgaattattgttccatctggtgaaggggccagcaccattgtggctgaaagtgtctggtccgtatcaggatctggtccctgaagcttctaaggcaacatattgaccagataagtgagtatgatgtgtgtttaacaagcatctaggtaaatacatgtgcgaaaggtgtgggagcgcagaatgggaaaagaaagggagtggaggtttacagcatattccaaagctgtgtttcgagatgaaaggaaacacatatgcagtttgtctcaaagttatatcttgagactggggagaaaggaggcaagaaaacaaagttttaaaatgtggtttgaagccaagctcctcagttacgctattaaatgcaatccatgctattaagacagaaattgtggtagagctaggatctagtaatgctaccctttcctgcctactgccagtcttggaaattcttgcccccagcctggccctcacccttcaccctaatgctaccatcatccatccgccccactctaccagtcccagtgcttctgcagtaccaagtcccacagccccataccagctgtaatggctcgagctttcccttcttcacttttgctcctgctggtgctgtgactgctgcatggttccacttgtcctgtccattgatgcagcctttggaaacgccaacttgaaaaataagcgaatggcaaaaaaatcctcctcctttcccacctcatcactatgtttacccagttcataattcaccttaaggtcatggcaaagagagagggtggggaaaaagtacaaatggagtgatggcagacaaaacaaacaaacacaaacaaacaaacaaaatgagccctctagtcattgctgcagcctgttggccaggagataggggtctgcttagcttagctagtagaggtggtgcttggaggagctatagcatgcaccaccccactcccgccgaattttttttttttttttttttttttttttgagacagagtctggctctgttacccaggctggagtgcaatggtgcggtctcggctcactgcaacctctgcctttgggttcaggcgattcttctgcctcagcctcccgagtagctgggattacaggcactgccaccaagcctggcaaatttttgtattttagtagagatggggtttcaccctgttggccaggctggtctcgaactcctgacctcaagtgatccacctgccttggcctctcaaagtgctgggattacaggcgtgagccacgtcgcccggcagcacgctgactttttccacagaacagcatagcattagtaaatcctgcctgcagagcatacaggtcttagacacagaagtttctgtatatccccctccccagctgagactttaacccccaaatgtccagggcccagccacaccagacatgttgggatgagctcattacataaaaacttggtgaatttgcaagagatgggacccctggggctgctctgccctagagtttatggccttcacatcttgaacacccctcagaggatttctccctggatgaacaatccatagcctgtggtttattatgggttagggttagggcttttgcaccacctgggggatagacaatgaaggcaactgccctcttccatcaatctcaaagtaaatacaaatgggaaggtttgtggtttcctcagcaagcagagctctgtgaagctaggtggcaccacaggatctacttcaaacaagaccccaatgttggtcgggcgtggtagttcatgcctataatcccagcactttgggagatggaggcgggaggattgcttgatccaaggagtttaagaccagcctgagctggtttctacaaaaaatacaaaaaacagccaggcatggtggtgcatgcttgtagtcccagctactcgggaggctgaggtgggaggaccacttgagcccaggaggtcaaggctgcagtgagccatgatagtgctactgcactccagcctcagcgacagagcaagaccttgtctcaaaaaaacaaaacaaaacaaaaaacccggtgagctctgcagcctcatgataggtgcctgggttggttgagtggttggagcacagaaaaccctagattggctcattcattatctacgttgtagggccagagactctggtttgaaataatagaaatctcttgacttcttaatatatgacttaggtgagtacatgcttatcagaaggacagttctccatccatcctgggggattcccattcagctgtggcagattagcagagtcactgtcatttcttatacttttctctatgatttcataggataccactgtataccactgtggtgacttccccttcactgttttctttatgttttattcttttctttcagtgtttaattttgacataatttcagacttaaagttacatggctgagcacagtggctcatgcctataatcccagcacttcagaaggctggggcaagaggatcacttgagctcaggagtttgagaccagcttgggcaatgtggagagaccccgtcactacaaaaaaattaaaaaatttgcccagcatggtggtgcacacttgtgatcccagctcttcaggaggatgaggcaagaggatctcttaagcccagaagtttcaggctgcagtgaactgtgatcacgccactgcactccagcctgacaaacagagcgagaccctgtctcataaaaacaaaaagaaagaaaagttgcaaaaatagtaccaagatttcctgtatacccttcacccacattcccgaaatgctaacattttacaacatttttcttaatcctctctgtgtctgtctttctctgacacacacacacatacacacacatataccccacatattatgtttgttcatagcatatgggaataagttgcagacatcttaaatacttcagtgaattttctaaaataaaggtattctttaaaatagcctcagtacaatagtcacattcaggaaatgagcattaatacagtactattatctaatctagaggcaaaactggctacataattgtaggggtacccagtgcaaagtaaaaatgtggagctccttgttcaaagaaacaggggaaaacatcactaaaggtactcaaataaaaggcttttttctttcttgcagagtctctctgtctctagacctctcatggagctttttatttattgtttctgtcactctccctcaggcacggggatagttgtggagcagtgcagaccctcagaactacctagggtccctgaccgctacttggtggtgtgtcctggagggttccgcttgctgctgaattcctcctcatgccagctgccagactgaagctctgtgacccagctaggggtgggaaatcaatcttccttgtccataggtccattgcaccaacccatggatgggcagtccccaagcgattgcaacctctgtgctgagacatgctcagtacaggatcaggataggtgagaggctggctcctgccaagtcaccagttgaatgtattgtgctgctgccagcctgggactgggacagtaattggcactccctgaaatgccacaggatgtgcacacctaactctgacccttcctgcaccctttcccaagcccccactgggagtggttggcaacggtagaacatgagcctccccttgccaatgtgattcaactgtcatctgcatagcagcagtcagggggcaaaggtggaaaggggcgggctgagcagagccatggtgtcagtgggtggagggcgagttgctgagaacccatcccagggaggcagcaagaggtggcactgctcttgagtccggacgcctagctcctggagcatgcaccatcgtctaattaaccttcacttacaaacacaaatttaaataactgagaattttaagacaatgaccacagggaattacatcctgggtgcagggtccttctgtgtccagggccctgtgtgatttgggtgcatgcctacaaagcccatctctagaccttattcggattctacaaattgtctcaataatgtcctttacaacaaaagaaaatcttggatcctgtgttgcatttagctgtcacacctctttaatcttctttctttttcctttttaaaattacttagttcaggagcagatcttcctttaatcttctttcatctggaaaagtttctcaatctttttttgtctttcatgacattaacattttggacgattaaaggccatgtattttacagactgtctctcaattgagtttatctgctatttcttcacaattaaattcatgttatgcgtttctggcaggaatactatagaaaagatactgtgttctttgtggtggatcataccacgaggcacatgctgttgatttgttttgttactaatggtgttaactttgactacttgagtaagatggtggctgcctattttcccatttgcaataaataagtatttgtgggaagatactttggatctatgcaaaaatattattacttctcaaaattttacccactagttttagcatacattgatgattcttgcctaaatcaatgattatttaatggttgctagatgatgttttccttttatttttttcttttatttatgttttttgtagagacggtctcgttatattgctcaggcttgtcttgaactcccagcctcaagagttcctcccacctcggcatcccaaagtgctgggattacatgtgtgaaccatcatgcccagctgttaaatgatgattttctaattctatccttgaccccttgtctacctttactgagccctttttggcttcctatccttgcctacgatgtgacattttgatgtgttccatctactcttctgagcctgtgggcacgatgcgggtaggggaggtttgggactctgatctctctgaggtttgggttaaatgtcttaagccagggtttactccattagttaatggagtgtcttactcccgagagggcattaagcttcactttcccaccatccttctttctctccttccttccttctataattcagagactatgagaatcatggctctgactcatagcttaacactttaactctaaaaaagaaatcccaggtccctcttttcctccatggtatcatgtctacaaaactaatctacaagtacttgttgagtacttattctgtgcataccgttttgcttggctcactgtagagaagaaatgtgtaaggcaaagtcactgctttcaagaacccacagctgtaaacatgaagagtagaagcaggcaggcctggaatatctctgtgtagtctacatggagaggtccaggggattttatgggatggggaggtaaataggtcatggcagagctgaactttaatgatagcaaactgattaaaaagcattggctctagaattagactttgattccaacaccatcttcattccttcctaatttgttattctgggcaagtaatttatctttctgaccttcaactttttcatttgtaagatacagatattaatagaatcttcttctcagggctattgcgaatattaaatgagataatgcatgcaaagcacttaggttggttcctgacatatcctaagtgtttcataaacagtagttattaaaatcttaaaggaaggtattatgtgtcaaaagcttttcaaatgcatgtccacagttgacccagaaattccacttagaatctatcatgagtaaacaaccagaaatacccatagtgattacttactatatcgagaaaacctcaacaacctttaacatttaacattaacatgtaaccattgaagcttgtttaaataaatggtgatctctttatgcaagtaaagctctacacatattagcaattatgttacagaatatttaatgatacaagaaaatctttacctaatattgtcaactgggtaaatctatgaatctgcattaatatatattcttaaactgttctctatcccatatattctttcattcttcccagaaacatttttaaaggacttgaggagcttgccactgccccaaggggcatttggaagatttttctctagcaagtgtgaattaaaaaatttaatgggacctcaatattatgtcaggagggttcttcccagtgctcatgtagcatatctggcacacactagcctctggtacactttgtgagagttaagtttatctgtttgtctttgcatgccagcaacttttataacacaagagctctcagaatccagacatggtgatttagaactactgggtatttgtactgatagggaccaggcactatgagccttaagctttcacctgtgaataaatctcagggaagaaggagaggagagggaagagaccaaagaatcgacattttctccccacagtgtggcctttttattgatttaaagagaagagacgtgaagctgcaaaacttttttggtagcaaagcagggtgtttttatcagttcttattttttgctttgaattctcaatgccactacctctgtccaagcttacaatccgtcataaccagatgatggtaaagctgcccaccctgtttctctaaacaaatcttcccaattctagaactgagactttttttttttttgagacagagtctcactttgtctctcaagctggagtgcagtggcatgaatttggcttactgcaacctccgcttctgggttcaagtgactcttatgcctcagccacccaagtagctggcattacaggtgtgcaccaccatgcctggctaacttttttgtatttttactaggtttcaccatgttggccaggctgatcttgaactcttggcctcaagtgatctgcccacatttgcctcccaaagtgctgagattacaggtgtgagccaccactcccagccaagaactgagactttaagctctcactgcatttgactctgggcaagttgctcctggtggcagtcagacttctcagatgactccaatgacctccacttcctggtttttatgcctttgtgtgttctcctcctcgagtgtggactgaacctagtgacttgattctaatgagtagtgatgtcatggaaaatgttgggacgtcacttctgagattaggttacaaaagactatgactacaataacttattgtatatttcaaaatagctagaagaaaaactttggaatgttcccaacacaaagaaatgataactgccttgggtgatggatatgccagttattctgatttgattattatacattgtgtgcatgtatcaaaatatcaaatgccccccataaatatgtataacaattatgtattaataaaaaaaagactgactgggcttggtggcttacacctgtaatcccagcactttgggacgccgaggcaggtggatcacctgaggtcaggagttcgagaccagcctggttaacatggtgaaaccccatctctactaaaaataccaaaagtagccaggcatggtggcacatgcctgtaatcccagctactcgggaggctgaggcaggagaatcgcttgaacctggaaggtggaggttgcagtgaaccgagattgcaccactacactctagcctgggtgacagagtgagtgagactccgtctaaaaacaaaagactgtgacttctaccttctattcagtctctctggagcttcttgcttgctcactctgataaagcaatctataggttatgagctgccctctggaaggacccactgaccaacgaactggaagtgacctgcaagcaactgaatcctgccagcaaccatataagtgggcttggaagtgcatgcttccctagttgagccccagccagccaacaattagacttcatccctgtagaagaccctgatccacaggactagttctgtagtccttgtgtcctgcctcttccctcacctcctgtgagagttcccctgaattcctgccctggtggtacagaatggtgtatccagtctgcccccactgcaacagaactgccttctctttgggaatttgtttcttcacagaatcacaggatgttattttcaaagggtgtctgtgcttgtgtttaaccttgtgctattttataataatgaaccattggaaaccaagtaaactaagtaaattacaatgcttggtaggtcagaatattatgtagccattaacaatgacaccagagaatattcacccacctgggaaaaagtttataatataatgctaagtaaaagtcttggtagaaaaaaaaaaacgctggtagaaaatagtgaaaatagtacacactctctctccctccttctctctctctctctatatatatatatacacacacactatatagagagagtatatacttattgtatatgagtactatttttactattttcatatatataaacatttataatagcatatataaatttatacaaaaatatatagcattatatactatatataaagtatatatactttatatgcatatataaagtaattaaaagcctatggagaggatattactttgagatgctaattggagctttatacctgtagatctacttctctttggtctttctctcacttctggcacctggacattctacctcatgcctggggaggagacaggacagcattatacagctcgcagaatatttaaattcttggcttgtagagttcaaaagagaaggttcagatctaagacaaagggcttatttggagataactgagcaattaagggtatcagggatcttagagatcattagaccatcggagctagaaccttaattttgggaagaaagtgttttaattacatcagagtgaatgcagatcacgagatgaaagaatatatgaaaaaccagaatcaggttttaacaaccccttgcttcctttctgctccccgccatgtataaaattctccccattggaggtttaaagaagagagttagaagggaaccagaggaaatgaatggtggtttgggatcctgagaagggggttcttaggccaatagggtaccaggtatatttgggaatcaagagaaatgaccacagccagggtatacttccacaactaggaagtatgaattgaggaaccactagttagaactgagaacccttgcagggtagatcagaaattggaacatgggaggtctatgtatagggtttttagagggtccctttgagtttcctatagtcctaggtggtacagagcagtgaggtatttcttgagctctaaggagcagcagtgaggtatttcttgagttctatggggcatataagtcactgagtgagctctcatcaaatgaggaggatgcaacagttacctgccagaaaaatatctggcaggaataaaacagtgtgtatatatgatagtgaccaagaatcaagcacacttcccattggatgccttggaattaagccaatgcactggaatgtagaggcaacccttaggggtatgtggccgtcaaactaatgaaatgacagaaattaatttccattacctggttaaatggaagatcaaaatgaaaattcaggccaattacaatttttttttttatttttttgagacagagtttcgctcttgttgcccaggctggagtgcaatggtgcaatctcgactcacctcaacctccgcctcccaggttcaagcgattctcctgcttcagcctcccaggtagctgggattacaggcatgtgccaccacgcccggctaattttgtatttttagtagagacggggtttctccatgttggtcaggctggtctcgaactcccgacctcaggtgatccgcccacctcggcctcccaaagtactgggattacaggcataaaccacagtgcccagctgccagttacaattttttaaaagacattttgagcatatctgagtttgtagtagagtttcattctagctacaaattgcacttcactgccaggtactcaatgctctttgacctccagactttcaccatctccatcacaattagaaaaattttctcaacagttgttgggtctttgcatcattccctccagatccaaagtccagggcaggagcaactgactggctaagttcatgtcacacactcgcactcaagcagccaatcagaagagagaggtagtacctggactcttttcgtttccatagaggagaggaactcagctaagaaccatcagctaccaaactcccagctggggtaataggcacttcattcctgaaaggaaatatgggtgctgtccatagcaactgccagaaacctttgggtaggaacctgaggcaagttcagtagtccgcccttatccgtggggcatgtgttctgagatcctcaatggatgcctgaaaccacgaatagtattgaaccctatacactatgttgttgtcctatacatatatagttataataaagtttaatttataaattaggcatagtaagagattaacaacaataataacaaaacagaacaattataacaatactccagcatcacttatcttgcattttttgggcattaagtaaaataaaggttacttgaacacaaacactacaatactgtgacagccgatctgataactgagttggtttctaaatgactaatgggctggtagcatgtgcagggtggatacactggacaaagggatgattcacatcgtgagcaggatggcacaagatttcaccccaataacaatgtgcaatttaaaacttatgaattgtttatttctggaattttccatttcatatttttgggccaagggtaactgaaaccacagacagtgaaactgaaaatatgggggaactactgtactcatatgaattttggcttttgctctgagttagatgaaaagtcaatgaaggattgctaatagcagagtatcaggacataaagaatctttctggctgttcttttaagaataaactgtagagagcaaggactaaagccctgagaccagttgggaggccatttccgttttaaaaaatggatgatagatggaccactaaagggtgggtgaacagcggataagtgttgtgtgagcgtgtggactaacttgtctatctccacctgtgctgaaggtttgtcttgtctgaagctgttgagtattgatagaatgatgcaattttagtcatgagactgtaaccaggccccttgagatttcagcaccccagcatttttagtgactaaaataatgaaaatgttttgcacttgctttttgcccaatattccttgtttccacaacaaaattatttgttgcaaacaaacagttgctgatgtgctgtttccttgttaaacggagagataacttcagggtcacgaaaaggtttgcaagaagaaatgaaagactttaaggacgttgtgactagctgctgactcccagaggtctagttgttccaggtgttacctgagagggaagaaacacaggcttttcccctttgttccctgaaacttcccctcccctactccccagccacattaaaagcccactttgttattgttgttaaggtggaattgagagctcttacccttctgccttcttgctttggttacattgaataaacatttctccatctccaaacacccatgcatcaatgttggcatcagctgcccattgggtacacaagcctgaatctggggttctatgacaattctggcgaccatggaagaaccttgtgcccatggctgggcagtcccaaccaggatctgcgtgcacagggagtccccaaagctgcctaggcaccttgcctgggggacacccctcactggttcctttcctgccagtggtgaccacttttggtgcaatgctcgcttggagtgaagacatgtacctgactttggtgtacttttggatttgcatttcctgggtgagtcaccacgacctttgtgacaattctcactggatagtgatctggatagcaccccatttgaccccagtttcatagcacaggaaggacaacggataggcccagccttacctgagtgtggcaactgtctaacagatccagggctagggaatgtggctttaatgaccgcctcaactactgacactgtgccctgtgctcctgaagaatatgtttcttttctctttcccttcccttcctttcccttcccttcccttcccttcccttcccttcccttcccttcccttccctccttcccttcttcctttcttcctttcttgacagagtttccctctcttatccaggctggagtgcagtggcactgtctcagttcactgcaacctccacctcctgggttcaagcgattctcatgactcagcctcctgagtagctgggattacaggcattcaccaccatagccagctaatttttgtatttttagtagagacatggttttgctgtgttggccaggctggtcttgaactcctgacttcaactgacccactcatcttggcctcccaaagtgctgggattacagatgtgagccaccatacctggcctgctcatgagggatatgtttcgatctgcagtcaggaaaaccaaccctgggcctgtaggtgcattaggaggggagatcatggacaacgtttattaggatactcagtgacatctttctcggtacataatgaaagtgttaccaaacaccggacaagttccctaaaactgttgcccaggctctcccaaggaattttggaaggagattctgtctgtcagggacagggtggtctctgaagtggatttgccaggattcctgatgacacagggtacttcttcagatatacgttgctcccatggtggggagtggctgtttatcaccacgtgcttagaaacatgtccattacttaaggattagagctaaagaaaggtgctgctatcacagcacagcaagtctttggattctctagctaaagttgtttagataatgggatagcattagattacctgctggctgaacaaggccaactcctcctgtttgtcttatattaacaccttggctgaagttgaagttgaaatgcaggtagataaaataagagagcaaacttcatggtggcaacagataaaaagaagattaactaggattaggtgattggtattctggattgttttcttggatctcacaagggatccaatctgtattttctggtatcgttacatttggcttatttctcttatcgttattgtaagttatgttttcattaatgtcatcatcaaatatagattaagatgctgctccaagactacaataggtaacagtacccagataatggaattgcagtatgcaggatatgggcccggcccctggaaatactttcaacttcaaatggatagattctgctcttcagtttccacacctttgcccctttttcagcaggaagtagctagaaaagaatgacaccccttttcctacatgaatgaggaatggaaaaaggcagtggggatttgtaacagggccccttgagatctcagcatccaagcatttttagtgactgaaataatgaaaattctgatcaggcccttgtttgcttgaacttgctttttgcccaatattccttgttcccacaacataatgataaactgctgatgtactgtttctctgtcaagcagtgggagttaacttcagggtcacaaaaaaagtatccaagaagaaataaatgtctttaaggatgttgtgacaagctgctgactcctagaagtctggttgtttcaggtgttatctgagagtgaagaaacacagacttttcccttggtttcctgaaactccccctctcttactctgcagccacataactctctgcttctttttcttaaggtaaatcggagagatcttgccttgaccaaattaaataaacctttctctatttccaagcacttgtgtgtcagtgttggcatcagctgtacgttcggtacaagagcctgaatttcggattctatgacaagattgggtggttaatgcagatacaattgaattatagagacaatgatcacattttctgaatctcaaggccagatagttctggtgtttcatgagtaggagacagagcttaaagccagtgatttaggtgttgagcaattcaggaatttctaggacattttggtaagacagaatatctgattggtgttagccatgatttaggtgttgagcaattcaggaatttctaggacattttggtaagacagaatatctgattggtgttagccatggagaatgctccctcttgtgaaatgttgagaagggaagagagagtgagggtgggtggtatggagccaggggctaggaatgaggcaatctctcttttgtggaagtcctcagtaggttggtgtgactgctgctctccaacctggaaaaagaagacagcggccatgggagacatttaggattttgtctcaggttcttcccagagatgatccaggaatcctgcttcccggtgttctccacaaaagggagatgtgtttgttgccttgccagcataacttggtgttttaaaatttttctgatacaacctttaactggaaatcagccccatgggggaaatcctgagatccatgacagagtgaagcatagccattataaccagggactttgcaaatatactgacatgagctcaatgaccagctctgccactttccagctgtgtggccctggaaacattactgctctgttttatccttggttcctcatctaccactgcttcctaaacttgagtgtgcccacaaatcacctaggaatcttgttacaaggctggtcatgagattctgcatttctaacaagttctcaggtgacctggaagctgcctgttcctggagcatgccttgagtagtaatctgatttttagggttaccctgaggttaatgtgtattatttatgaagagcttagcatggagcctggcataatggtttggagttattgttcctcgggcaatgggaagcagctgacttggactttgggggaggactctgaatcagagtggtaagtaagggacagtgcccacatgaatgccccctcttcaattctgccctccatcccagaggaagtctggaaaaattatggattggggggtttacaatgcaatggaaaaggccttttggtgggaccaaggatgcctctgttttgttcccaacctgtgatcttaaagaagtccctccgcatctatgggccctcttgaaataaatgaaagaaatgattcctgtgtttttctcctctctctccaagttgttgtaattggtgttgcttaaggcaaaccaaaagactctaggaccagggctcttcactcctctccccatgtagcccttggtaggaagatgtggttgagccttagtagataacagctttcataaaaattcactttttttttttttttttgagaccaagtctcactctgtcaccaggctggagtgcaatggcacggtctcggcttactgcaacctctgcctcctgggttcaagcgattctcctgcctcagcctcccgagtagctggaactatgtagtgtagtagcatgcgccaccacacccagctaattcttgtgtttttagtagagacgtggtttcaccatgttggccaggatggtctcgatctcttgacctcatgatccacctgccttactcagcctctcaaagttctgggattacaggtgtgagccaccacgcccagcccactacttttttttttttttttttttttaattaaaagtgtccttaacatcttcagtttctccccagctcccctttcttccctggtttctgttgtttccttgtttcttatttcacaagaccagaaatcccctccttgtccaatgtaggcccttccaatgttgtacccgaatttccaaatccaccctctctgtccttcaaaacctttatctcccagtgggttaagcagtaattcatactaaggtgtgaatggttgctctaaatttccccagtgtatttgtaagtacgtgtatgttttaaaaaggaggtcttgagattgtaaacatgattgcaacatttatagaatttcaggcacagagatgaagcacttgtaggagcacatcagggagaataaatgtgggggtagaggaatgaacctcttgttcacacacacacacacacacacacgcaaatgccttctatggccctcagagcaatcccgaatccatggagggctgtgttcttgttagaaaatcaggtgaacttgcagaatttctcacatttttctttcctcaaaaagttgttgctgttgcctccgcagcctccgtaagcaaataactcacattcaccagtttcaaagttgaaaaaccatcgcgtcatgtaggtttgacaagggcccttttccataggaaaagcgcatacatttgggaggagatccttgatagtgtctgaagagagaaagtggttgaaggagaccaaacccatcaccttctccttgtttgcctcatatgccaggggctgtgacagccctgggcacaattgtgaggccatccacaatggctgtgctctgtacctctttctacccagctatggtctgatctgtctacacagaagttgacattttcacttctgagagtagcctgatgtggtgataatcataggcttgagaatataactcaagtggattgagatcctcgcgcagccacttgctactgtgtgatgttgtataaacctaacttcttcatgtctccatttcttcatttgtaaaatcaaggagttgaaccacatcatctctgagttcccttccagatctacttttataggatttgataataaagatcctcaggtttctacctcctgtctcataatcaattctagaatcaatatcctatgagagaaggaggacagactttgaatctgagagcaagattgaatctgagagggttcaaacttgtctcaattatcttctagctatgtgatcttggacaaatgacttatctccttgacattcaatttccttcattgcaaaaatgcaggtgtaatatccacatttttggtttattgcagggttagagattaccagtgaaaagcattgataaatagaaaataaatcaataaatagtagctgctcttaatcattctatttcttaaccaataagactcttgagaagagggacctcattgtactcatttctgcagccttagtgcctaacacaggcctagttctcagttcttagcaaatatttgttaatagaaaaccaccaccaccaccccactgagcccctctggggcaggattaaaagtttctttgtaccctccttttatgtttctgtcaccatgtgggcagttttactcttcatggtagctagtagaatttccaacattatgtgaagaaactaaggccagataaatgaagtacctgtcctaatgtcaggctaggaagcagtaggaccaagaatcaaacccagcatggttcgactgcaaaggcttgcaggttctccatccatcttggttgttgtaaaatgagtgaatgcacagatgaatgatcacacctatggtggaacttcaggcagcagcctagggcttggaaaggttcagactctgtcttatcctcctacctgcaaggctgacgctaagggtgcaggagaatggggaagaggcagaatagcttattcaatccaggtgggaggtggaggggcatgttcttaagacatcctagtcactgcatcatcggcccttagacccttacaggtgactctgtaggggctggagtcccatctgctcttagttttctcagtcttgcttctctgctcttccattccattaaaccaaaggaaaatcacttgacttgcttcttttttatgtaaagtagataatgacaccctgtgtgtgtgttttgagtgtgacagaagctgttctaagtgctttacaagaatctattaagagctaagttatactgagagcttgacatacatcagactatttgattaataaagcagaaaagatggttaatctttttttatagaagaagaaactgatgctcagagaggctataaatgatgttcctgaggcacagagtttgtaagtagaggagcctggaccagaacccaggtgtgtctgactccaggaatgctcatactgtaaaccactacattcttcttacttatggcagacattttcaaacttgagtatgcgtcagaatcatctagaaggcttgttagagagacccacctccacagtttctgatcaggtgggactgggaactagcatgtttccagttgatactgctgctgctattgctgtcagactaggggacaaactcgagaaccactcatctataaggttattgggaggtttagagttccatttatgtctaagaatctatcattaatagctccatgtacatacatgcagagaactatgcttgcacatgcaagaatgttcactggcacattgacagtgataatctccagagggtaagattttgataatttttcaccttctttcttacccttttgtgtattctaatatgcatttttatacagggcatcctactggctgcttaaaaatcttggaaactgctgcctaccatccccatttccagcagattatcttagctataactgcacttcatctccccacttccatttgcagattccaagcttccacagagaaagtggtccaggaaggagccttttctgacaagtgcatctaacttggctaagtccctcactctcaaattctggctctgatctccttttcccaacctctccttgcctgccaccagccccaccccagacattgaaggccccttttcctgctttacttatttcattttctatagcactttgatcatctatcatttgtattaggtattgtatgtctctctcccattagcatcttaatttcacaaaggcagggtctcaggctctttgctttaacctcagcacctaggacagtgcctggcacataactatgtgcccaacatatgtctgatgaagtgaattgaactgaattgactctcaatccggtaaggtaagaaatgggctctgtttgtgctgcatcacctcccccaccaccccgccccccagcctgattcccagtctattctttgagatcccacatttcataccaacctcgtgctagttctgatcgaagctctaggcagagagtgagaatcaggagaaacgagagagaggcctgaagctgcatggtgccactcagccagtggctcagcctggggttgccattttagggagaaaagggaccaaggggaggagcctggccccacatccagctcattcacctttaactcaggcttttcatggggctgggctgcctcaggaacagagtgttcagccaaagcacagcttcacctctctcctcctggccttatctgatctggccacccaggctactttagtaccacttcagggtggaagcctttttcacaataataaaaagacagcagccatttttgagtacctttccttttccaggcaccatgcaaaatagttttcacacattgcttcccttaagtctacacgggaatcccacaacactaacactcccattttgtagatgagaggaggttatgctactttgaccattgttacatggacagcaagtttcagagacaagactgagaccccggtctgtctgcttcagtgccctcgtatcactcattcattcaacaaacattcatcaagtacccacactgcaccaggcaaagtattagatgctgcctccatcccatctgggtgctcccaggaaattatggcaacaacacacacaaacacattggaagtcagaaacagtcacctacttggaggaggagcagattcattatattttaatagaaatatcaaaagcaccatgtagaaggagggcccagctttgtttgcttcagagggtcatggtctctagagacacacccccagaatccagcacattccaactgtctcctttccttgactctctagagatccattttttttgaaagacaaagccagcatgctttagggagatttagtgagcctcagatttaaaatttgaggttgtgatgggtccagctattctttttcaagaagcattctatcatatatttattattatttatttttaattgagaaataaaaattgtataaaggcagtccccaatttacaatggtttgacttacagtgtttgactttatgatggtgcaaacacaatgcacagtcagtaaaaacagtacttggaatacccatacaaccattctgtgttcacttttagaacagtattcaataaattacattagatattcaacacttcattataaaaggggctttgtgttagatgattttgcccaactgtagactagtataagtgttctgagcaagtttaaggtaggtaaggctaagctatgatgtttggtaggttaggtgtattaaatgcatttcaacttctgatatcttcaacttaggctaggtttattaggctataatctcatcataagttgagaaacattatatatttatgaggtacaatatgatgttttgaaatatatgtgtgtatatatatatagagagagagagaaattttctctcttagcaattttcaagtgtacaatatgttattaactacggtcaccatgctgtgcaataggtctttacaacttattccgtctgtctaactgaaattttgtaccctttgaccagcaccttcccaatacttcccacccccagccccgggtatccaccattctactctctgcttctgtgacttcaacttttttagattccacatgtaagtgagatcacctggtatttgtctttctgtccctggcttatttcacgtaacctgcaggttcatccacgttgtcacaaatggtaggatttccttctttttaaaggctgagtagtattccattgtgtatacataccacattttctttatccatccagtgacggacacttgggttgatttaagtccagctactcttgacctgggcaagtcatttaacgtcttccagcctcagttttctcatctataaattggggttaattatgttgctttagcatacttcccagaattggtgcaagtgttcaataaatattcaaatgcctcacacattgtgaatgcacacacaggtatatgtcttttgcaagggatgcgtgtgtgtgtgtggcaatgatgcctttttgaaaatgggggtgctaactggatcagcagcatacttagttgctacagaaatgttttccccatctttgcacattagttatagctcttccttttctttaaattccctagaaccatgatactcattccttggccattgctttctctaactatagcttatacaattgttggtcgatcctctcattatctattgatctttgctgtttaccccacatttatttccttgaaggcacttctgaagcctacattgcaacatctctttggtataacttcttttgcactttgaggggtccaccagcattatccttgatatcgcctttcttagccctcttgggtgatcaaatctgttcatcagaaaacaaaataatgatagaaggaagaaataaatagactgtcacttgttgtgcaggcagaggaaaggcgggggcgcctattgatgatccttggctgagagcttcctgcagtgttgcctcctctggggcaatggatcaggaagtgagaagctgcctttaaacgtactattcaggaaagcaggggagggagtgatactgcccccaaggacactcggcaatgtctagagacatttttgattgggggcatctactggcttctagtgtgttgaggcagagatattgctaaacaccctatactgctcaggacagccctcacatttggcatcaaatgttaatcttgccaaggttaggaaaccctgcagaagagcaatagatacaaacacttttttaaaaaattataataatatttccaacattaacagcatgataaggatccagtgcagtgaggggcagtgcctgatgaggtgtgtctgtactcgtttggccaaacaggccttgtgggaaggtgcaacaggacctggcccttgaaaagctcattctgtactcaggttgccctggggatctttggtcatgactcagtgaattggctctttctcaggagatctgggtggcagtgttattgtaattccagaaaggggagggcaagtgtaagatttattaaaaacacgttagagcagctagaaggcagccctagctagttatctagcacttatattcattgcaggaatcttactaaccctatgtcaaccatatgtgtgtgcatgtatgtgaaaaatcattacattatttttttaaaaactttaataaattcaggagctacatgtgcaggtttgttacatggacatattgcacagtggtgaagcctgggcctgaagagtgaatactgtacaccataggtaatatttcaaccctgctccgcttccaattcacttactactttttttttttttttttttttttgagatggagtcttgctctgtcacccagtctggaagtctggagttcagtggcgtgatcttggctcactgcagcctccacctcctgggttcaagagattcccccgcctcagcctcccgagtagctgggattacagacgtgtgccaccacgcctggctaatttttgtatttttagtagagacgggctttcaccgtgttggccaggctgatcccgaactcctgacctcaagtgatccacccagctcggcctcccaaagtgctgggattacaggctagcgccaccgagcccagccccaattaacttacttttgattgagacccattaatttggctggtttaaggaaggaggaagtaaataagggtgggattttgaaagaataaagtttcacccttcaggttctaacctccaaatgacctttctcttttgtagaaggaagaaggggactaacatcttatgagcaccatatgtcaggcaattcatttaattctggtaaaatatagtaacgttgcaccagtatagctctatttcctgcccctcctttgtgcttttgttgtcatatatattacatttatgtctattatagcattgttataatcaagagaagaccacatacacacacacacacatacacacacatgcccttatatacacatatacacacttttatatttacatacttaccatttctggtgtttttcattccttcctgtggatccaaattaccatctgggctcatatcctttcagtcttaaggaaaaagtctagtccacgagaagcatcacctcctctcagtttttgtttatatgggaaagtctttattttgcctatattttctttaattcaaatttttattgagataattataaattcacgtacaggtgtaagaaataatatggtttcccctaatgttaacattttgaaatgtttccctagtttcccctaatggtaacattttgaaaatgggatatatatatatatacacacacacatatatataaattctttttactataaggaattggctcacatgattgtggaggatgataagtctaagatctgcagtcagaaaggtggagacccaggaaaaccaatggcacagcaccagtacaagtccatgggattaagaactgggagagccaatgatgcaagctctagtctgagtctgaggacctgagaaccaggagagccaatggcataagttccagttcaagtctgagtgtggagacaaccagtgtttcagcttgaagccaggtaggcagaaaaaatatatatttcttactcagacttttatttcattcaggcctgcaacagactggtcaaggcccatccacactggggagagcaatctgctttactcagtctaccaattcaaatgtcaatgtcatccagaaacatccttacagacaaacccagagataatgtttaaccaaatatctgggcaccccatggcccagtcaagatgatacataaaattagccatctcaagtccattacttgtcaacctggcacccatacatatctccttagactatacttaatcttaaaataaagactattacaaggttataatcccacctaacatgatacaattatcctgcagacaatggaaatacaccaacccctttcccaaagagaacatagtttttgagtgacgtttactcctcttgatatctcatagcttaaaattctatgatgtaaaatgaacaatacttaagtactatgaaataaagtcaatacatcttatgttgcataataaggaaataggaaagggaagaaaacaaagatatttgcttaatacacacccatattcataacaaaataaggaggactactcatgacaattacagtttttgtttctgtaatggtcacgtggtcatagctggtatttataactacttttccccactacccattctgtattgcctttgccttcagcaagcacctcatctggtcattgttctttacctgggcaagtgacccaaactttcattcttgaagggtttgggccatttgctaatggtcctgcctgggttgggttgtagttttccattggccttaatcaaagggcatggtaatattaagagttgccccaaggaatcttccgtattccggacacactcttcctttacctgtattgtgcagtacttcaatttcccccttggtagtctggatcaataaccccagccaacatagtaatgcctttctttgcctattaattcagaggcaggaggagcccaaagtggccagatgacagtcttaactttcagttcagtggaatcattgttggttctctttgtgaaagcaggcctccttttggaactgagacttctagggaagcatagaataagatcatgggaataggaagcaaaaattttgctagtgggtcaccagggataatagtgaggaatgcctactcccatttccactcttttattcctgggcacatgaatcctgactatgggagaaagggtaccatatattggaggctgattcagagcatctacagcctgcaggaaaaccttgccccccgtcctgcaaggtactatcaaaccagctgcttcaggatgctgggaaatacaataagatcagtgaattccatgagcacgggcctattgctgtaattttttttttttactgtgacatcagttccttgataagaaacaacactgtgtgaaatactatgacagtggataaggcgttccataagtctacagatggtagttctggcagaagcgttccatgcagggagggcagattagtgttcagagtaagtatctattctagtaagaacaaaacactgacctgtccctgatggaagtggtccttatctgttgtcttaccttcctctttccctccctccccaccccctttcccatgcccacacactgcccatcaatattttttaaaagctccccaaatgattctaattttagcccaggattaagagtgattctcctctgactttcacatctaataataacccactagaggaatgtttgcctctcatcctcccaatcctgggcttagtgggattggtggtcttagtgctcaagggaggaatgcttccacaggaaaatactgttgggattttgcagaattaagagcaaacactgccccttggatatttttggctcttcataccacttaatcaaaagagagaaaggggagggtgtcactgcacaagatgggtggttaatcctgataaccaaggggaaattgggttgctgctatacagtggaggtaaggaagcttgtctatatactagttctcctgagaaacagagccaatataagattatgtgtgtgtgtgtgtgtgtgtgtgtgtgtgtgtgtgtgtgtgtgtgtaattggctcatgcaattatgtaggctggaggtcaaaaagtcccatgatctgtcatctgcaaactggagacccaggaaagttggaagttggtggtgtaatttagtctgagtctgaagacctgagacaagggtgtgaatctttgttcaagggcaggagaagatgacatgagatgtcccagttcaagaaatgaggcagaaagacgggacaaatttttctttcttccatcttttgctttattcaggtctcagtggattggatgatgcccatccactttcaggagggccgtctactttactgagtccaccaattcaaatgctcatctcatccggaaacaccctcacagacaaacccagacatgatgtttaatctggatattttggggcccagtcaagttgatgcataagattaaccatcacaacctagaacccaagggattcattggcacctcttagaactcctttgtacaatagtcttgatcaatgaaaaactgtgggaaccccataaaggaaagattgtgaagggctcagactgcacaggaatgaaagtttggatcacctcgtcaggtgaagcactccatctgactggcagaaggtaatggaaacatagaaaggatgccaggagaaggcagctatggttatcaccttgaacttcatgaccagccacacagagggggtctgtagtcgctgttttatgttagttgtctctttcctcccttcttccacaattgaatatgaggaacattggtgatggctagcattttagcttttgggtatgtgaccaactgacacccacaatgatttggtgaccaggaggactcatgcaaccccgtaatgggacatggacttttcatgcggacagaacccaagagtgaatgttgagggatggatttgaatttctttctttccccttttgaacctacttaccccctcttctgtgccctgctttatacctcagaaaaccaaatgtatgggttgtatcaacggttatcttgctttctggcttctccttggaaccagcccatggggcacagagggagattagaggaaagactgggactaaggtttgggtatttattccccatcttcctctggttgtgtctccacagtctgcatggatgcctcaatttgctcctttcaggataccccttccatatagatctctgttccagtaaccagcccctccccttggtccttcacattaaggggtgttttattatacgatgcatttccattcattcaacaaatatccattgaagacctctcctgtgtcaggcactagtaagaaaaaggcacaacgctttttcctcgtagagcctaatgtctagaggggagagaaacattgaataatgtcacaattaaatacatacctacagattatgataaaagctatgacagagttaagtacaagatctgcgatgaagatttgaggtgaagggaatccacacatgtggaccagcacatgtgagtgctttgggggcagtaaggagctcagtgtcagctttgctgacagtaagagggagagaagcttgacttgacaaggtttctcagtgaattagctctggggagggagttgtgggaaaaagaggagactccttagacatgaaaagtaaagtacattggagttaaacatacttttggcctctccatgtcctccttttactttactgctgaattgaaagaacaccgaagatgtgctcattttgcttgatgaattaatatgctaaagtaggcagtaaagaggaaatcagtagcagggagagaaaattgtgcaaaaggacagaaatgatgaatcatgaatgatgcactctctactggacaatacttagcagaaatagcaaattaagaaggatgggtctttagaataaaagttaatagcagaaggaagcaagaatgtgcaaaattatgatgaatcagaagttttgtgacctacatttaataatacttttcaggaatgtgatattaaatcaggagtattagaccagtagttcccaaactcacacggcatcagaattaccttggatcttataaaatcatgttgtatactttaaatatacacagtaaaatttttttaaaaaggaacattatatagaatttacaaaaaagacttaccttgggagcttaatttatttataaagtttagttttttgggaaggctctagaatctgaattcttggtgtactggtactagtgagctactgcctcaggtgatttggctaaaaaaagaaatccgtggcttatcaatgatagacaatgtattaaacaagtactgaaatgcatgcccattttcttcagcatctgctgttgttatatgacatctgagatatcttaggacagcccaggtagcagtacttgttgattttgaaatgtaaagctcactgaatgggggtagaaatttccctccaaacacaaaacccaggtctcgatgacaattaggtgggctcagttctcccttccccatgattcagctgtggagtgcagctggtctgacaagaggcaggtgttggcaaggaattggatcctgagaggggtgtggtctacagtgttttgctggatcttctcttcctctgggtaagacaacttaccccaatcctcattgctaccaccactgatatctttatgaaagtccctggggttggggggatgagagccaaggaagtgccacaggcaagtctgtggtgggggaagcagttacccctccaggctctggatgcttcttgttcttcaaaccagctgcatggtacctcctcagagatgcagctggccatgcctccccacctagtggaccaagtaccatttgatccctcagaggtctcaaccctggctgcagaaattttagaagaagagtgccagtcacacagctcccacctctctgttcccccagaggtgtgagcactatgtgtgcctgggccccttgtcttaactcctgggttctggtaaccccaaatcttttatactcccaaatctaggagtgagggattctaatattcatgtaaccaattctcagtattaaatcctctctgagtgaaagcttggctctttcagttcttatactgggaatactggttttaactcccaccaagacttccctagtagggagtcctagtaggaattagatttaggtactgaatattaaaaatcgaaatcacaaatagtcactatatccatcctgatttccaactagtctgtgggatctggcaacactttgccacccttcagacctggttagctccagttttgttactcatttgctgtgtgattttagacaagtccatttcccctactagaagcttccatttgtgtatgtgtttttaaaaagagagggattggggctgctggagttttctaggcccctcagcttagacactccctgcatttccaaatgatttaagcttcctctgggcatttttggctctggagacagctccaaagagagaagaaggagaagaagacgagaggtcctggatatgcgtggtaccatgggaaacacctgaagattccacttgagatgtcttctgggatctaatggacagagtcatgagcaaacagtcagtgataaagagacccaacgtactccagccccactgaggtcttgcaaggcaggggttctcagtgctcagccctgagggctttgagttcattcttgagcagagcagtgatcagatactgctcaccacacggcacattctgaacatttccaagggcctctttggtccatgggtgtcggggacagaatgattctgttccattcattcatgtatgtcaaccccaatcaaggattgaagagtgccagtgagaaggacaagcactaggtgcttatcagatttggcagagtccttgagctgctgtattttctcaaatttagaaatacactttgacatcattagtccatcgtcttcatcttagaaatgcaaaactgaggccccaaggggagcatccctccaccctatcctgttccaaccacagcatacattcaaccaggggtaaagctgggattcagatttggatctctttattcccagacacgtgctcttcccataggatgcagaccaaagatgactggttagtaatttggtctgaatcttaaggatgcacaggactgggataggcttcccgggagcaaagaacaattctcacagaggtatggaggcaagagcaaatgtcaacatggggagataccacacatggggacaatgtggctggacagacactttgcaaaactgccaaatgagcagccttttcagggtcttcatcacgaccctgacctgaccctcccacttccaaggattctaacatcttcacctactctccttctacaccagaaacaggcaccatagacttcttttgttaatggcaagacatttgtcacaattttattgtaatcactcagaatattccagaatactattgatcttctttcatactgtggcaaacactttaaaaacattatgtcttgtctatttggggagttactttctaacaattgcattaaacctcattttcggccgagcacggtggctcacacctgtaatcccaacactttgggaggctgaggcgggcggatcacgaggtcaggagttcgagaccagcctgaccaacatggtaaaactgcgtctctactaaaaacacaaaaattagccaggcgtggttggcacaagcctgttatcctagttactcaggaggctgagacaggagaattgcttgaacctgggaggcggatgttgcagtgagccaagatcgtaccattgcactccagccttggtgacagagtgagactctgtctcaaaaaaaaaaaaaaaaaaccacctcatttttctcagtaattatttggacttagctgtaaaatttttaacagatttattaaaatatcattgacatataaaaaagtatccatttaaggtgtaccacttggtattttgatatacatatacattatgaaatgatcaccacattccagctaattagcatatctataatctctacatagttaaccatgtatgtatacgtgtgtgttgagaagatttaagatctactctcttggtaaatttaagtatacaagacagtattgttagcaatccttaccatgccgcacattgtatctctagaatttattcatgtcgtatgattgaaactttatcccctttgatcaagattaccccatttccccctcccaccagcccctggcaaccatcatcctactctctgcatctaggagctgtattattaaaaaatgctaagagagtagattttaaatgttcttgccacagaaataacttagtgaagtaatgcatatgttaattagctagatttagccattccacaatgtgtgcgtgtgtgtgtgtgtatcaaaacatgttatttgaaaaagcagtatgtaggggaaaaaatcatgttgtacacaataaatacatacgattttatctgtcaatttaatgtaaatttttaaaaattctacatataagtgagatcatgtagtatttctctttctttgtcttgcttatttcacatatcataacgtcctgcagttccattcatgctgtgccaaatgggaacatttcctttttattttttaaggctgatattatcccattgaatatgtatgtgtgtattttattttattttattttattttattttattttattttatttgagacagaattttgttctgtcacccaggctggagtgcagtggcgcaatgatagctcactgtagcctaggggctcctgggctcaaacaatcgttctgcctcagcctctcaagtaactgggactacagacacgtgccactatgcccagctaattttttaaatttgttgtagggatgggggtctttctatgttgcccaggctggtctcaagctcctgggctcaagcaatcctcccaccttggcctcccaaattgctgggattacaggcgagagccaccatgcccagcctttttctttcttttttttttttttttggttttcctctttttttttaatttcattattattatactttaagttttagggtacatgtgcacaacgtgcaggtttgttacatatgtatacatgtgccatgttggtgtgctgcacccattaactcgtcatttagcattaggtatatctcctaatgctatccctccccactccccaaaccccacaacagtccccgatgtgtgatgttcgccttcctgtgtccatgtgttctcattgttcaattcccacctatgagtgagaacatgcggtgtttagttttttgtccttgcaatagttggccttcatctgtcaacagacattcaggtcgtttctggacttgccgtgaataacgcacagtgaacatgggagcacagctttctcttctcagtcctgacttcaattcctttgggggggatttctggatcatatggtagttttagttttaatttttttgggatcttccatattgttttccataagtagctgtaccaatgtacattctcaccaccaatagtgtccaagggtgccctttttctaaattcttgacaacacttatcttttgtcttttttatgatagccatcttaacaggggtgtggtgacatctcactgtagttttaatttgcattttcctgatgattagagatcttgagcacatttttatatacctgttgaccatttaaattttttcttttgagaaatggctatttaggttccttgcccatttttttcagcttcccaaaattgttggatgtccatttgttaatcaggttacttgtattcttgatatgtattcttgaatagtagtcgtgtgagttatttatgtattttggatattaattctttacagcatatatggcttgcaaacattttttcctactcagtagcttgccttttcattttgttgattgtttcctttgctgtgcagaagattttagtttgatataatcccacttgtctatttttgcttttgttgcttgtaattttgatgtcatgtccaaaaaaaattgccaaaatcaatgtaaagatgattttttcttttatctttttctaaaagtttttatttttctccccctagctttattgaggtataattgacaaataggaattgtatatatttaaggtgtgcaacttcctatattgataatgtataaaatgatcgccacactcaagtgaattaacatatacaccatcttacatagttaaccttttcttgtgtgatgagaacacttaagatccaccctcttagcaaatttcaggtatgccatacagtattgttaattgcagtcaccatactgtacattaggttccagaactaatttatcttgcataactgaaatggaaactttgtaccctttgaccaatattttctcatttttctccttcccccaccccatcaccccatcctccttgtaattaccattctactcactgcttctatgagtttgactattttatttatttatttatttatttgacaggaactcactctgtcacccaggctgtagcctcaaactcctggcgtcaagcaatcctcctgcctcagcctcccaatgtgctgggattacaggcatgagtcatcactcctagcccaagtttggctatcttagattccacatataagtaagatcaggcaatatttgtctttttgtgtccagcttaattcacttagcatgatgtcctttggattcatctgtgttgtggcaaatgacaggatttcctactttttaaaggatgaatactattgcatgtgtgtgtacacatataatgtatacatatattgtataatgtatatatacgttgtatatatatgtataacgtgtgtatacacatgtgtgtgtatgcatacacacaccacagtttttaattcatttatctgctgatgacatttaggtttttttcatatctttgctattatgaataatgcttcaatgaacttggaagtgcagatgtctcttcaagactttttaaagaattttagtttcaggtcttatgtttaagactttaatctattttaagttgacttttgtatatggtattggataggggtccaatttcattcttttgcatgtgaatatctagttttcccagcaccatttgttaaagagatcttctgttgcctattgtgtgtttttgacaccctcgtcaaagatcaattgaccataaatgggtgggcttagttctggcttctctattctgttccattggcctgtatgtctgcttttctgtttttatgccagtaccacactcttttgattactctagctttgcaatgtaatttgacatcaggaaatgtggtgcttacagctctgttctttttcaaaattcctttggcaatttggggtcttttgtggttccatatgaattttagcattgctttttatgtttctgtaaaaaatgccattggcattttggcagaaattgcatgtgctctgtagattgctttgggtagtgtggacattttgacaacattgattcttctaatctatgagcatggatgtcttttcatttatttgtgtcttttaaatttccttcatcgatgttttataattgtcaatgcataagtttttcacttctttggttgagttaattactgagtgttttgttgttgttgccgctgatggaaatgagattgttcttggtgtataaagttgctattgatttttgtatgttgattttgtatcctgtaactttaataaatttgtttattaattctaacctttttttgcagtgcctttagagttttctacaatcagttttaccagccctttctaaagagagggaagcagagatggcaacagcatcaacagcaaatgaattccagcctctttagagccccttgatccaagttatattaaacaacaaacttatttgacaagagatagcaagtcttggtgtgctgtgatgacaagctgcctgttgtgaggttcccttctcaagcctggcatcctcttatcttgcccagtcctatgggtgtctctttcttctttctctctccctatccttccttctactcccttttcatcttttttttctttctttttttttttttgagaccaaatctcgctctggagtgcagtggcgcaatctcagctcactgcaacctccgcctcccgggctgaagagattctcctgccccagcctcccgagtaggtggtattacaggtgcccgccactatgtctggctaatttttgtatttttagtagagacagggttttgccgttttggccaggctggtcttgaacttctgacttcaagttatctgcctgccttggactcccaaagtgcctgggattacagctgtgagccactgctcctagcccgtttccatctttgatcacctattctgtgaataaattttctgaaaacttagcactttaaagcaaccattttatattgtgggtcagccatctgggaagcaatctgcttggtggttcttttatagggtctttcccatggttgcagtcagatgtctgctggggctgcagccatctgaaggctctattgggttgggcatctcatttgcatggctgaaattgatgctggctatcagtcagagcttatctgggcctgctgatcacagcacccacatgggtctctctagcatgggcctctctcagagtagttggacatcttacatggcagtttcccactgcccccaaacaagctacataagaggatcaagtgggacttgcacttattctagcttagccttggaggtcacatagcatcatttttgctttattctcttggtcaaagcagtcacagagttttctcagattcaaaaggaggggacatagatcccacttctaggtggaaggtgagtgaaagaattttaggaccttgctttaaaacagtcacaccatccagtgtcttttcctccttcacccctttcttctcccttcctctttaactcttctctgctttcctccatctccccctttcatgcctgtccagctattttcaattttggagtttctgcaccatactatggaactgtcttctttactacaactccagtaaacaagtccatgagccctttcagagacggacttaccatgaggtcgatggagccaagcctcagggtcctcgctcgagcgagccccttttaagattctgggagtgcttctagctatatgtttacatggtcagatgacttgtaatatctgcaaaagtaagatattctaaccataatcgccaatccaccttccctttccactctgacctttccctctgtcacacttctcctaggtcaggtggtgtttgggcgactgccagcattttaggcatgcaaattaaaaggaagttgagttggggatatatttattttggagttagtagaatatatttaggtcgttagctgtcatttgtatgtgtaggaagttgctgctagctgtcctggtggagaagcagctgcaaataatactcctgttttctactgggcctattcccttgatgttatgacactaagttatgggactagaggttgcactgtaaaatgaatgttcttagcccaagaaggttgcgggtggtagaggagaaacaagttttgaaatgtgtggagccaggaaaacaagcctgtgtagcattctttcaaatatcagatacatcaattttttttttgagatggagtctcactccaccgcccaggctagagtgcaatggcacgatcttggctcactgcaacctccacctcccgggttcaagcaattctcctgcctcagcctcctgagtagctggggctacaagtgtgcaccaccacacctggctaatttcttgtatttttagtagagatggggtttcaccacgttggccagtctggtcttgaactcttgacatcaggtgatctgcccccttcggcctcccaaagtgctgggattacaggcatgaaccactgagtctggtcagatacatcacattttaattagaaaaaaaaaatcagctcttatggaagcctgttcagaagttcttttgtagtaagcatatacttgataattcaatatgtacaattttaaatgtaccatgcattttttctttttttaatagagttgtacaaaagataatttattaaaattcctgtgtttctaggacacaaacctgtaacagaactgcagacatcaagcatggcttcaagcattcaggtacatgttttatccaattcacctataataaaaattaaaatatcatattttgatccccacattaaataaaaagttatctttccattctctccacagaaatagtgctttacagaattgaggtcataaatgtaaacaatgaattattaatttatatgggttttgtgcaatttttactgtttgtcagcctttaaaaatttgcagctggttgcaatttccctcctcatttgaaataatattctcttttgtactcatttgtgcttggtttctttcttttttcttttctttctttctttcttttttttttttttttttttttgagttttgttcttattgcccaggctggagtgcaatggtgcaatctcagctcactgcaacttttgcctcctgggttcaaacaattctcctgcctcagcctcccgagtagttgggattacaggcatgcaccaccacgcctggctaattttgtatttttagtagagatggtgtttctccacgttggtcaggctggtcttgaactcctgacctcaggtgatccgccctccttggcctcccaaagtgctgggattacaggcgtgagccaccgtgcccagcctgtgcttggtttctaaaggagctcctcatttatcaggtttagaccatacaaaatctggatctgcactggctccattcttcagcatcttaacgacaactttaccaaagtaacaatgtcactagcattctcaatttgcaggattttcatactctctcccttttttggtgtcaccagaaaatgcaatggctttttgttctctgaaaattgcatatagagagatgtgagtgtatgtcaatatcagcatattgcagatgtgaattattcagcctcggagagatcggaccccacagagcactttattaaggcaactgaagccttcatacaaataaatggggggtctgaaagttgaagacatagagtttcatactgagaagtggtcaaggggaagagcattgtgtttgaagagatgctacgctggaagaaagtgtgtaagcaattcctggggttcagtttctggaacagccaaggtttggcccgtggaagccaatttggagcatcaatcaggcacacgtggagagaggcctggattatgagccaaatcctggaggttattcaagctcctccttatggtataaagtaaggctgacctgtgaagcagaagaataaagggtgagatgcttggaccctgaccacattaggaaccaaatcttgcacctaatgggaaaaaggaggtgggatcatttttacatctttgggcaggaatggaatgaaggtgagtttgggggctcctagaatgatcatgagttctgacttgtccagtagagtcccagtttatgcctgttgtctcagtgtaataattaatggcacctcaccttgagacactttcaaaagtgatttggtttggccaataaagtatgtggttgccctggttagaaataacctttcaaaggaagagaagtagcaacaaggtttagtgagaagtaaaggactataatgattggctgatgaatggtgcccagggctgggctgggtttaccgggcttccgtctgacctggtctgggatactccaccacttctgttttctctctacacccactactcacctcatacttgccaatatccctttgactaatccctcccttcccaccctctttcccaaaatatccttctacttatacttctgcattggagctggttttgtcatccccagcgccacccaggtcttggaatagaccagccaacacccagacctcccagtgtggccttggtgagcacaggagaccgggacctctgggacttatggtattttttgcaggtgaccagacagatagcttcagtttggaagttgttattgttcccctggctaccgccatagatgaattcggagcagatcttagttttttttattgtaccaccagtgtggtatggaggccaggcaggggccagcctcctgtggcatactgcatatatctgcagggagatcgcagaatagagctgtttgggtgcctgtctccctggagaatgtccatctctccccttctctggccaccattccctttgtctccactgagaagcaaatttgcctcagggctctgttcccaattcagtgtgaaccctgaccactcattttacctctctggtccttgacttcctcatctgtaagatgagaatacaaaatcccaacctgctcgcctaacagggctgttggaaggagcagctgtgacatcacatggcttctttttccttgcctccccaacatctgaacactaaatctggctgattttgcctcctaaatagctctcctttatttccttccggctgctttcttaattcaagcataattatcttttgcaaggactccatgaaaggccaccagctgatctccaagacttctccaatctgctcaacattggtttccagaatggccgatctgctgggcacaggataaagttctaccaaacccagagggacttcagaatccattttctccttctcctctccagctttatttcttatgctgccccaacacccaacttcccaaacttatgctctaaaaatagcactttcttacacaccccgtgcctttgcacatgcctgacatatccagccccctcttgctaagtgaactcttgttcattctttaaaaccctttccggacattgactcttttatgcagtctttcctggattcattctttactctttgcttttcttcgttgcttctcagtcttgcacacacatttatcatttccatttactttcttgttcatattttctgattcctccatgagaatgtgaggtttttgagaggggattgcatcttatgccatcttgatacagcagtttctagcaggtaatttggcatagagaggatgcttcaggagtattcacagaaaaaaaaaaaaacccaaaactcaaatctaccctgatcttaagcatttattgagcaattattttgcccatagtgctatgaggtacaaatagagttctttagaacctcaggtctgaagcacgacaaaacaacaattgtagcattgattagtgtcagcacaacaaaacaacaattatagcattgattagtgttcttagtagttgacatctattaacatttaatcttgtaaagtaggtcctctcattgttctcattatgcagatgagaaaactaaggtttagagaggctaaataactttcttgaggccacacagatggtaagggatttgaacataggttaatccattgctgttaggatcaagaccagatcccttaccagctctccttcccccaactagcccagcttcatcttcctctctttttaaaatttgttacttgtttatttatcaagagaaactatttctcagcccacatattcatgcttcatggttcaggaacacaagtcagtgacaaactttaacccaaagaaattctttcaattccaaaatcactttgtactctgaaagataccagccttcctcatctcctgaaaatctgttatagaattacaatttctctagaaatctgtgtatgccttatttcttggttcagcaacagcgaacctatagagagctgcaatccatagggatgcaacaaatgcttaaacaatatgaaaccacagatgcctggctggaaggccacacatttgaggttttatcaaagcactgaaaacctagttattgtcttgaaaggtatgtcaacctaaagtaacaagattcagaaaatatcattaagtagggcatttatttgaccccaaaacttgaggatggccacttgggaatacagattcaagttgccctgaatatacactaccagtttcctgtttcttgtctcttgctcactctctgctttctagcctttctagacctgaacatcctgcctcctgccacagagcctttgcacatcctattatctggcctgaaaggctatttcttcccatttttggtctaagtactcatctttcagatcttaaatcatggatctctttcccagaaaaacttttctgaccttcctggccacaatgagcaagtggaacccatcatgggtgtcaggggcaccaatcaatatttgttgaatgaatagaatgaacgaatggtccttgatgatcttctttagagctcaataatatgggcagagaagaaagagtgtaggcggtctaaggtggtcagggaaggcatcctggatttatgtagacagagaggcctagagaaaaaagccaggaaatacagattatatacctgtctcttatagctatcatataacctgacacaatgttggcatttgatgagactttggtgactacttggcatctcgagaatcactgaagagtagccaagagaccatgtggtccattatccacacctgtcttatggaaagggaaactgaggcccagaaaggaaaactacattgttcacatcacttaccaaaatagaggaagaaatgaaataaaatccatgtctcccaagtccaggactggcagatttgtgtcaagtagaagatgtacctaaactcttggtcagagaccagccatcagtgaactaggagacagaggtagtgcagtgcaggtggagataggaggtgagggcactgggtaatttaggaagcatctgagttacctttctgaagtctaaacatttctttccacggctgaacgggcaacacttcatgttttctgggcaatctctgggtttggtacactggtctatttcttccacttcgcattccactttgattttgggacacggctctaagggaggggaagatatattccctcaaggccttaaaggagccagtgctccccctccccgagaccagggcacccctccagagttagagaactttgtttccacttcacctatccccagaaggtagtggccctcagggggctcaggaatttcacaacactgctcacatccccaaccccataacaactcaccatcggatgcctaaaccaacccctaccccctacccgcaccatctatgagattcctgagagaaagacgcattcctctaagactgttctggtcactcagccttgctgtgcttggttgctcccccaggaggtgctgtggctctcgatgattgagattaacatttctggcatcagatagctgggcttttgaattctgtgagacgcttggtgtgccaggcactctctctgagccttgatttcctcatttgcccatagggttgctttgaagactaaccagcaacacagtttgacaagccatcgtcaaactgcctggggcaatgtaacgtaacaatgagtaatatggatgaagcacttactgtgagctgccttttctccttaatcctcattacaaatctatgggtaagtactcttaatattcacattttgtaaacagaagaattggaagcataaggagattatgtgaatttgcccaagatcacacagctactcaggggtggagccaggtttgaacctacaatgtgtggctcctgagtgctcactttcaaccactaattttcagtgcccagtacagttagctgctaattgtgagtcttcacatttcagcattccaagggacttctggagaccattctttaacccaaagaccagggtcctctgtgggtatgggtgtgggggctgcaatgagaacatttggaagttgacacaggtggtgttgtggggagcagcctgtttttcttgtgggagacttccttgggcttactactccttcttagttcatttcatgagctctaggtccaggcacctccaggaagaactctttggaatggcagcaaggagtcacttgccacagatttggatgcctgtattcaccaagggagtctcttaccaagagacttcaaatagctcccctctttcccacctggaattccaggcagaggtggagaaaataatttctcagctgcaaaattattctttgttccttcctccccactgagtttcctttccccattgcaaggacggagttcccaatacttactgccaaggatgccttcagcgtgcccaggttcctggatgtcccccaaaaggatgaatggtaccaggattggcagaagtcctgagagtcccattttaggaagtactggcctggttgatggcaccaaaactaagaactgctcctcagcagctcctacatctgcactttgcctgccccggtgtggcccagcaccttaagagacagccctggagacaagccagccagactccccgatcaggaacaccagatccctgaggccatcagtgggactacctggtacctacactgggggataggtggctcctaatcctcagcaatctgaggctttctggtctaccagggaaagagggcacatgttgtcttgggctttccaggctcccttagcagaaggggaggtttaactccagagtcttccatttcccagggggagtttgcaggttaacagtatgctagctctcttccttctttctaatttcactcttctcctgacatgtctattcttatgttttatttttctcactctgtttcttctcttttctgtgcatctgtatgtcttttactctgtgcctgtctttttctcagggagtctctgtctgtctgagtctctttctccccgcccttcacttccctctctcttctttcgtatgtaaagatcagttacatttatcctttaagtcgtttgattttgcaacagtaaataacttctttcattactttgggacttctccaactctgttctccgtttttccctgttgtcacagctacagcattggattaaaagtcacaccctgaagcattaacgcttgagcatctgtaccaagttttatatccttggtataagcccgaaggaggtgaggagccagttacctgggcatcagttccatctggcaaaggactgtgggtaatggaagcatttctgcagggtggcagcagggtgtgtgtgcagcaaggcatgtcatcagtggtgagtgagaagttcattcctttttatggccgaataatagccaatgcacattgacagcctcctacctctagcatcagtccctaattttctgctgtgggttttctctggcccccagggagcttgtatagcttgcaagtataacagtttgaaagagcgagggatttagtatccctggcatccagtgggcgttgggaatcagtggacaaatagcttagctttcccatcactggagacagattaagaaaatttgtggtctgatatccagaatctacaaggaacttaaacaaatttacaagaaaaaaaacaaacaaccccattgaaaagtgggcaaaggacatgaacagacacttctcaaaagaagacatttatgcggccaacaaacatatgaaaaaaagctcaacaccagtgatcatcagagaaatgcaaatcaaaaccacaatgagataccatctcatgccagtcagaatggtgattattaaaaagtccagaaacaacagatgctggtaaagctgtggagaaacatgaatgcttttacactgttgggaatgtaaattggttcaaccattgtggaagagagtgtgccaattcctgaaagatctagaaccagaaataccatttgacccagcaatcccattactgggtatacactcaaaggaatataaatcattcttttataaagatacatgcatgtgtatgttcactgcagcactatttacaatagcaaaaacatggaatcaaaccaaatatccatcaacgataggctggataaagaaaatgtggtacatatatgccatggaatactatgcagccataaaaagaaatgagatcacgtcctttgcagggacatggatgaagctggaagccgttatcctcagcaaagtaacgcaggaacaaaagtaaataccacatgttctcacttgcaagtgggagatgaacaatgagaacacgtggactgttgagggggcagggggagggaaagcatcaggataaatagctaatgcatgcggggcttaatacccaggtaatgggttgataggtgcagcaaaccaccatggcacaggcttacctatgtaacaaacctgcaggtcctgcacatgtatcccggaacgtaaaataaaataaaatatttttaaaaagaaaatttgtaagcctgttttacatgattctttaaaaggtccccaataggattgagccacagtagtaaccagctcataatagactcttctctcttcccttctcttccctgaattactcatctcactccccatcttgtatgtcctgggaaatctctcaaacaaactacctgcacccatgcccttttcccagggttagtttctagaggatccaaactaaggcactgtccttgggcccttgcctaaaaagggttttacaatcttttgtagaaacagaggaagataacaataacaatattcctggaactctgaactctcaaagttctgattgtcttcactcccttgaatgatgtcaccagaagcctcaatgatcccttactctgcaaagtgtaatgtgccaaaaagatgtcaatcactcagcctcaaggcacaggactacatcaagtactttactggaaaaaattgagagtgacacaggtataaactgggagttctagaagttggagataaaggggacataaagatgaaatcaaaacggatggatattgtgcatcaaaagagccaaagatggaggaagaggaggtagatgcaagcgttctgttctgggaagggctaagatcttggaatgctgagagtgaaactggaagccagtctggagcatccgtcaggtacaggaacagtactcagagcatgagccacattctggcagttcttccagtgcatccttatccaatcagggaaagcctgcagagaacgtaggacagaaacagctgagcatcttgggttcagctcatctttggagcttgaagttatgtttatacatctttgcacagaaagacactaaaaagtagtgggtttgctttggggagctctccatctccttcaaggaaaaacaaataggagtgaatcgctgccaaagagttgtgttgagacattgatggcttagaagggttggttggtcaacgtgtcttaagtttagcgtcctgtgcctcttctgcaattcatctctgagatttcaccacttctacacccttcctccacccctcctaattcccctcatacttgccagcattgattacttctacatcccttctcatcctcagttcctcatactcagaaagtaactttgtcttgccttttgccaggtgcattcttacctcctgatcagagctggttctgtcagcaccaggtctgccaaagatgtagctgtcctggaatggaccagccaacacccagacctcccggcatgggactggagaggatgaaagaccggggcccctaggacttacgtttattcttgcaggtgttcaggcagttggctttggattggaagttgttattgtttccctggcagccaccatagacaaacatggagcaagtattatctttcttgtcataccaccaatgaagaaaataagccaggcaggggccagtttcttttggcatttcgcatacatctgcagagagactccagagttgaaaactcagtgtgcccactccagaaataaacagttgttattattctccctggcaactgctatagaagaaactggagtaggctccttttctcttatcacatggcaggagcacagctccactgacatattgcacacatttgcaaggagaccccagagtgggcatctgcatccctggagatagggttgttgcaggtgtaattagctaaaatgaggtcagaccaaaatagggtgggcccctataccaatatgactggtgtccttatacaaacaggttaatttggacagaggcacacacactgtgagaacaccatatgaatgtgaaggcagagatcggggtgatgtgtctacaagccaaagaacaccaaagattgccagcaaagcaccagaagccaggggagagcaatggaacatgcttcttccccataaccctgacaaggaaccaaccatgctgacaccttgatctcggacttctagcctgaggaactgtgagacaatacatttctgttgtttaagactcccagtcagtggtgctttgttatagcaactctaccaaacaaatgcaggtcccaactaaataatgcttacacagttccatttgggtaaatctccactgctaaacaattagatcctgttgatttttacctcctaatagctcacctctctgccagtctctttaatataagcctcagtgtctcatgcctggactgttgaggtgacctcagattgatccccctgcctccattcctggcccctccaatcaatccttcatgcttcccaccagagagaaggatctgatggatctgagagccaggcttatcatgtcattgcacagagaagacctaccttcactctatgacaatgtcctcccatgacccacaaggcccttcattgtctggctcctactgtgacgctggcctcctctcctgccgcagaacccctttgagccacatgctccagcagtactcaacacaccgtgctacctctatacctccatccctttgcactgctcacagtgacactcttcttacttcaaaacctttctcagacatcaactgctgtgatgtcactcttgaccccattctacattcctcactgccacaccttgcttcagagtcttgtgcattcatttttcatttgtttatatcttcagtctcatccctgaggctgtgagtttctagtgagcagggagtgagtttctagtgtatctgctttcatcttggcatcccaattcctaacaggtagcctggcacagtacagaaccttatggaacgttgaggataaacgaaatgtatcctgatctgaactgaataaattattcattgagcacctattatgtgctcaatgcttcaaggaacagagaaaaggcatgatctctgctatttaggagcccttagccaagaattacaaataagcgaataggtatcaggtggctactgtgtgccaggcataactctaatcacatcatgcagatcaattggatcctcaaaataatcttttacactgatccttttattatctgaggaaactgactcacagtgagggaaagttgttaatttatccaagacaaaaaggctcgtaaaaactggaggtaagagttgaactcaggatggctgaattcagaatccttacctgctggcatatgagtgacttagccccctaacctgcccactctacttctctgtcaagtcctgttcactttgcctcctatgtcctactctttctttcaagcaggtcctactcttcttcatcccctcagctacctctagttccggccaccatttctatcatcttgaagtcctttaagatactctgttcctcctattttaaactcgatagatgtagtatgaacctggtcatatgatgccccgcctcggtggattgccatagcccttgggatccaggcaagactctttaatctggcccaccatacctgaattgtttgatctctgcccacccagaatctgttttccttgtaccatgctcgtgctcactctgcgttctggactcccaaggccccaccactgagcctttgtgcatgctactgcctgtgcctggaaaacccctccacccactttttgcctaaaacattacccatctttctcaactcaaccccagattttctttctcaaagaaggcaatcccaacccccctgaccacactgagaccaaatcctattgtgggtctcagaggcactcaatcagtatttgttgaatgaataaaaacagaatctttgatagtctttttgcatcccagggtgatgggcatgaaactaagatgcagcagaaaggagaaaccctctgttctggagcagtcaggagaggcgttttggtgcaaagttggatttgtgtaggcagagaggtggtcactccatagcaaaaaagttgggaaatataaattgcttaatttatcacttgcagcatatgttagggcaacgatggccacctgggagctcaaaaaattataagagtgacaggtatccaaatagccaaaagaatctgattcaatgccactgattcaccaatgatttgttctgggaaactgagtctcagacattacctgataggataaggtcattcctaatggcacacaccatatttggcacagtaatgaatctaaatcgcaggtctcccaagtccagcagttttgccagagaccagccctcagcgatcagggcacaaagccagtccaggaaggcagaaggtgaggacagggggaggaggggttggttattctgcagctctgaatattaccttgtttgagatctaaacatttttttccgcagctgaagacacaacacttcttgttgtcctggcattgtctgtcctttgtacacacatccctttcttggaattcacattcttctctgattttgggacatctccctagggaaagagcggttttacacccgtgtgccttagagagcatagtgtctccccactttgccagacacaaggcaattctagagagtcagggaagtttgctttcagtttgcttgcccccaggagttcttttcctcagggcagcctcactcatttccctactgcctacacccccaccactccccagtgacctctcctccctctattcccaccccccagctccatcccatctaaggcagaatttctcaaccactggtgatatttgggctggataattctttgtttggggggctgaactggggattgtaggatgtttagcagcatcccaggcctcttcccatcagaatccagtagcacccctgattgtaacaactgaaaatgtctccaggcactgcaaaggtcccctggaaggcaaaatcacaccattgtgggccactgatgtaagccaatgcggtctttttggccttgttgaggaatccatgtttggaagttcctctaggtggtagtattatacagcaattagtatcacttaccccggagccagtttagattttgaattctgacttggtctgaattctgaccctctctgaaccttggtttcatcatctgtaaaatcattttgcccttacggattttgtgagaaaacaatgagacaaagtatataaagccctaatcaaagtaactgatgcacagtcatattatctaacatttgctaagtatttaccataagccgagcactcttctaagcattttaaatgtatgatctcatttaatctttataattgctctatgaaggaagttctattaatatccccattttacacatgcggaaactgagacccatgaaatttaagtaacttgcccaagattacagggctaccaagatttgaacccactaagtctgattccagatccctctgttgttttagaaatcccttttcagaaatccttacttcctgagtgttcagcaaatgataccaatgatcattgttacattatagtcatggaattaatattccacaactaatgtgtcttaagtttaaagagacttctggatgctgtcctttatctcaaagttagggaacccctagggatacagggacactttatgggactacatttgaaagaaccaagagtggatagagatgatgcctcaaggaaggggcctgttttgcttgtggggtaaggagaaggtcccttggtttcccggattcctgtagcgactcccctgaaagctagatcctgtgactctcctccacctgcttgataaagaccctccacttcaaaggagctgaaagtggggattgcctaagttggggttactgcattcccagaaggaatcttacacaggagggatcttacaaatatctctctcctctcccaacccgggacctgggctaagatggtggaaagcaacccacatctgaagagttcttccctgttccttcctcccagcaaactcccctctctctagggtaagggctgaggccaatacttactgggaaataaccaatcagtcagaccaggtccctggacattcgctaagaggacgaatagcaccaggaggctcaaaagtccagaagatcccatgttgaagagaggccagcctttctggtggttcccgaatttggaatgctcagctgctgcaccttggatataagaactggagacaagccagccaccccctttcttgctgggaacactaagttcccaaggtcacaaatgggactaactggcacccacagctcacagcttgggaggaagggtctcttattgaatggatcttgatccttacacccctaggctgcactgggctgggggctctagtcaaccacagggagtgggcaaagcgtgtctcccactttccaggctaccttcagagtgaatgccaccatcttgggtcttcatcttgataacttggagagtggtggaatgtcctcattcttcattcattttccatcgtacgtgcacacttactagcacactccttctgcttgtctctgacaatgtgtctctgtcggtctcttggtatctcattgtttatctgtgcctctctgtgcctaagtctactgtttctctttccccatggtctctgtgttcctttctccctctcccacagtttcctcccatccttctgtcttttattgtatctttggttcactcatattcgttgactaaggccaaagaatacagatttgccacagagcagggtgtaggggaggaatcaggctgatagcagagtcttcagagaatgtttctcaaagttttgttgctctgagagcaagagaggatatcagagcttagagggagcctttatcatcactgccagctccttgatgtctgaggaactatgaagtgaagggacttgcctgggagactgcagtggaataaagttcagtaacacagcagactttggggattctaactgggctgctagaggagctgtgggaaagaggtgctggggaacttggacagctttcctttcctacagccatggaatctacactggccactcagccagtcctgggaagaagagagacactctttacagagtaaatgttatcccgagggctcccgttttcttctctaactaggagttacccttttgggccaagtttgttctccaaattttcctacatgacagacagaggccagacaaagacagccttattatcagagagtgactatatggtcacaaaatttaggatcacagacagccgccgtaagaatcccatgccaccaacttgacaatctcacttgaagagactaccgaatcaaatttttcttttcttttttcttcttttcttttcttctcttttcctttcctttcctttcctttcctcttctcttctcttctcctttcctttcctttcctttcctttcttttcttttcttttcttttttttctttaaaaacattcttgctctgtcatccaggctggagtgcagtggcacaatctcggctcactgcaatctccaccttcccggttcaagcaattcgtgcctcgacctcccaagtagctgggattacaggcatgcaccaccatgcacagctaatttttgtatatttagtagagatgacgtatcgcccttggccaggctggtctccacctcctggcctcaagcaatttgcccacctaagcctcccaaagtgttgggattacaggcatgagccaccgtgcctggctagaatttctaatgaatgagtaagacgtcgtaagcagtgctgtttcactcatttcatttcccatattctcacaaactcagcccaggagagagtgaaaactggaatatctaagtggaagggctctgagggaccatcaagccctatttctcaatttatagatgggaatcataaggcccagagaagtgaggatgctgactaaatgtcacccagcaagtgagtgtcagaaataagattaagagggagctgagcacacaagttcttgccagaggacaccagggcatgttttgatgttggtgtggatataatattttcttgtagagttgaaggtagagaggaagggtgagtctaaaggaatgaagtaatgtctttagtggagacagaggctgaacacccacaaagtgaaagtcagtaaatttctttttttttttttgaaacggagtctcactctgtcacccaggctggagtgcagtggcgcaaacttggctcaccaaagtcagtaaatttctaaatggtacccagggtccccaattaaggctgcattttttcgtaaattttattgaaaataaattaactatctttctggttgcttcattccattctgtcttgcctaattttcaggcccatccaagcatctcactttccaagcaggtgaaataaaatttatgtctttgggacttgggataaatcatggttttggccccttctctccaataatttcttggagaaggctgggtaaggacccacctggggttttgcctctcctttcttcatcctttctcattgagggcatggtgccctacctctgcctccaggccaattctctcccaggaacaatcctgtgcttagaacaggggactccaacgagaaccaacaagatcagcctctacctggcacctcctgctttttcattagcccaagatctgtcacatggactgattctctgtcactggcttcctatgttgttccctctgcctctaactctattactaagttacatgtttgctcccccaagtaagctctgaactccattaaacaggtctgtgtctagaacgcagtgcttaaaacatgaataggccccaaataaacactcagtacatcttgctggaagagcaaggtaggtgggggggattggtaggtgtgtgaataggtaggtagctatgtggatggatgggtggctggtagagtgtgataagtgggaagatggttgagcagggagagggattagtgaggaaagcatggatgtttgggtacatgaatgcatggattatggatgggtggatgattgggtgaataagtggattggattgaatataaagatggatagggtagtgatgggatatgtgggcctattgatggaggctgtttgaatgaaaggtggaagagtgcattggtagggggatggagggagttaggtatagaaatgatgaatatgtattttgatgggtatgaaagagtgtgtgcatgtgtgtgtgtgcagagaaagggggaagagagaggtcaataataggaagatgaattaaaggctagatgggcaagtgggtctgtagaagaaagatgagtaagaaaagtaagtggatagacatatggagtaggcaaatagctaagttgaaaagtgtgtcagtggaaggaaaggagggataggtgagtggggattgggtatttgcatatgtgttgagtgaatggataggtgagtaaagggattgaatagttagtaaataggtgggtggaaacatgaatgtacaaatgaaagcattaaccaaagttaaagatataaaagaattatatagagaacaatttatgctactctaaagtaatacatgtgaaaatataggaaaaatggatcaattttaccaaaatacaaaagaccaaaatttgcagaagaggaggtagaaaacctgcagactataagatgaaatatttaaaaattactaaaatataccactagaaagaacctgatctagatgcttttggagctgaattttggtagccttcaaaaaatgctgaattgctatattatgtaaaatatttcagagcatagaaaaagtagctaggtttcccaattagttcccatactcattttttgaaagtaatatgacccaaatagaaaaaacaaatttaaaaagacctatttttcttttgactatagatgtgaaaattcaaactatactattagctaaaaagaaccaataatatattgatacagcagtctgcaattaagtttattaagaatgcaaggatggctcaagaaaatttagtaatttattatgccaacaaattagaagagaaaaatcattatgtgactgtatgcttaaaaggtatttgataaaattcagtagtcattttcagtagtagctataaatggataggaaataggcttaaaaaggaaataactggccaggcacagtggctcccacctgtgatcccagcactttcggaggctgaggtgggtggatcacctgaggtcaggagtttgtgaccagcttggccaacatggtaaa[141 bp omitted]caataagagcaaaactccgtctcacaaaaaaaaaaaaaaagaaagaaagaaagaaaaggaaaaagaaaataatttaagtgcaataaaacttatgtattccaaattcaacaacaaatatctttttatagtgcaggagccattgactttaaaataaggaactagacaaggatggatgccattgcctttattttcattattattttggaggttctacacaatacaagaagacaagaaaataaagtcatgaagttgaaaaaaagccaaatatatcatcactttcagatgatgggattatatataaaatcaaagtaacatcattcaatattgtgatacttaagataatttggcaagttggatacaagacaaaactgacagctctttatcatgctactcataattaatgattttgatgataatattttctacttactattcaacgtctggggtccatacatttcagtccacaatgtgagcagcacttttccaccaatgggcactcctcatcctgcaggcacttgggtttatcaatcttggtacatagcaagggcttgcgtgggcagaaaccttttttgactttatggggtaaaagaaaacacttgaccttgaaatacttggtcataatttgagacaaatttgaggaatcttgggaatctcaaacaaggttttattctgattaagcttcttacctttccccctacagtaacaatagactggaggaggcagagtatcaactttctacgactaataacttgaggagcatcaagaaaagtcttaccatctctgacttgtaccatctgataggattcctgtctgctcctacagaattaatggatctgggttatataaccccagagtaccacaggtggcaggagtattagcacacagaaccttcttgttttacaaattgtaggcattgaggcgtatttagagggaaatgagttgcccaatgccacatagaaagccagtagaaaagttgaagtaggttgaaaagccttggactcctgccaccacactatactgaaccttagaaccttaaagccacacctggacaatccctgggactacatggggaagtaaacacctgccttagaggaggcaggaaagttggcttctatccaacatcatttgctactaatgttttccccagcccatcttacaggatatgaatatgatgtgcatgctttgaagttctgtgcagacatgagggcttattaggaatacacctcatggttatgaattttttatgaatcggtgaatattgtcaccttgcaagtcattgaggaatgagtctcagaaaaaataagttttcttggggaagaatagagagcaatgctatgaattactggctttgaagaacagcacaatagtcttcagaggtcaagaggtcaatataacttgttgggcattaaaaggggttcccaaagatcctcaaagatgagcccaaggagcatctgaggttcaagacaccccccactccatggagacagcatgacatccttggcacatgcccaatagatttgggaggtatatccccaatccttacctgtccaggccctggcacaaacaaagccacacctggattcacaacatttgtctgtctggggacaatcgatgtcactgtgacatgaaggtggacactccttacgttcagtgaaagggaagagtgggcattgtccatccttaactaaaataagagcagatgtgagcttcttaaaaccccacccccatcccaccacccttcaaagagcctttccttctcttcaaagctagtatccctttctgcaacttggttcaccctaccctatccatctccagtaggctgtggaagaatgaaatgtctcatcatatcatgggatatggtagagagcatgctgggcttggtgccttaagccccatggtaaagtcccagtcctgctacttggtgagtttccttctctgtaaaatgaggataattatgtgaaatctacacaaatcagtgtaagccattttagggtatttggttttacttagaatgaaatggggatccatcacactgttctcagtagagaagtgatatggcctgactcatgttttgaaagggtcattgtgactattgtgtttataatagattgtaaggaggatagaagcagggagaccttttaagaggctgttggggtaatccaagtaagaagatggctcttcagatcagggtggcagctgcggaggtggtaaggttttaccagatttaggatctactttcaaggtagaactaaaattatttcctaactaacttaatggatgttaattgataaagagaggcatcaactgtgattgtgaagtttttcaaccaagatgagaagcatggatagaaccggtttgcgttaggggagtgatggtaagaggtactggtttatgtttatgttgagcttatttttctgtttttgagacagggtttcccactgtcactcaacgaagcctcaatttccccagctcaagtgatctttgaggaggtgggaatacctcctcaagtgatcttcccagcctcctgagtagctgggaccataggcacgtgacaccatgcctgttttttttgttgttgtgtttttgtttttgtttttggttttgttgttgttgtttgtagaaattgggtctcactatgctgcctaggctggtctcaaactcctgggctcaagtgatcctcttgcctcagcctcccaaagcgctaggattataggtgtgagctactgtgcctggcccgaggttctgtttaagcaagttcaacatgagatgtttgtgaggtccaggtggagatgtagagcagatagtggattttaggagtcagattagggctggagacacaactttgtgggtcattaggacataggtggtatttaaatcaattctttggggttttgtatgctcttgtactcatctgactgcaaattctacaagggcttccccaggtcaggctcaggctatgatgtgttgaactctcagaggtattatcaggttgcctctgagtcttaacctaaatttcccacaaaccagcccaagcccatttccctggcctcctcttccttgtcttcctgggagaggagacaaggctcttgtccacagcaccatgattccttagagcttcccatgaagggaagcttgtggtcctagtttcaagtcaggtcccagggttgccttggccgttcaggcccatgggtccatggaattaaaattccacctctactcctgaccaactgtgggtcctcaggcaactaacttcacctctctgactgtgttctcccatctgtaaagtggtagtgatggtacatttttcagcttgcctcacagaatctgaggtcgaaattgcaacgctgcctcataaatcacacagttgtgaagatcactggtcaccatctcaattgttaccgtttagtgagcccacaccacgggaccaccactctatcaagtctttgtgttttaaatcacatataatcctgccaacaactcaacgagctgtttgctgtgactccagaattacagaagagggaactgaaattcaaagaaatgaagaaagcagcaagtgggaaaagtcagatttaaattcaggtcatttgactcctaagtttggtaggacactgtttcccaacattgctggtgatgatcattatactaaggaatgaatccacagccttcaccttcaccccaccctactctccacctccagtgtggacacttactccatgggattccagagctggcctgtctacacttcattcttaagcaaatcctcagtatgatgctcaacaggttactatgatgaggaaacaccttcttccaagggggcacacctggctttcgggtcacattggccaagatctattaacattttctatacactatctcattttttggcagagccactccattaggtaaatactattattaacctcattctatagacaaggaaactgaagcttataaaggcaggcaactggcccaagacctcccagccagtgaatgacagagctaagtcttgaaccaaggaactttaacctcaaatcctgagcctataacctcattggtatactatttctagttaaactagaccctcagatttccaggatagaggtctcaccaattaacatgcaggccgttctgcaggcatcctcatttaagaagttgttggcattcccttcgcagcccctgtatttgaagggtgtgcagcggtaatttttaaagtcaaaatgccagcgctgtgcctcatgattacagtttccatgcctcacaggtagcatgcagggttctgaggtcaggaagcaaggaaagaaggatatgaagagtagagataaaagaacagggtcagttccctagcatttctcataactcctggtgttatcacccaagtcataaaaggagccatggcaggggaaaaaaaaaggcataggttctggtcccagttctactactaatagtctatgttgtatggcacctctgagcatcactccttccttgcaaagaatattacaaggtgcatataagaatcttgtactttggagctgatctttcttctccactgtcctgagctttggtagggcaagacttgttcagcaactattaggttgatgcaaaagtaattatggtttttgcattgttaaaatttgccatttgatattagaatacattcttaaataaatgtggttatatcatatatcattttaatgcacatttcttgcttcctgtacttttgctaatgacttattatttgctgtttaatttatatttattttagactatataaattatgtcagacaaaaagcaaattcgagtgattttctcatttgagttgaaaatgggtcgtaaagcagcagagacaacttgcaacatcaacaacacatttagcccgggaactgctaagaaatatacagtgcagtggtggttcaagaagttttgcaaaggagacgagggctttgaagatgaggagcattgtggctggtcattggaagttgacaatgaccaactgagagcagtcatcaaagttgatcctcttataactacataagaagttgccgaagagctcaacgtcaaccattctatggtcatccagcatttgaagcaaattggaaaggtgaaaaagctcgataggtgggtgcctcatgaactgagcaaaattaaaaaaatatatattgttttgaagggtcatctcttattctgtgcaacaacaacaaactatttctcaatcatattgtgacgtgcaatgaaaagtggattttacacgacaaccaatgatgaccagcttagtggctggaccaagaagaagctcaaaaacacttcccaaagccaaacttgcaccaaaaaaggtcatggtcactgtttggtggtctgccgctggtctgatccactataactttctgaatcctggcaaaaccattacatctgagaagtatgcttagcaaatcgatgagatgcactgaaaactgcagtgcctgcagccagcattcgtcaacagaaagggccaattgatcaacagaaagggccaattcttctctgccacaacgcccaaccacacgtcacacaaccaacacaaaagtggaatgaattaggctacaaagttttgcttcatccaccatgttcacctgacctcttgccaaccgactaccacttcttcaagcatctaaacaactttttgcagggaaaacacatccacaaacaacaggatgcagaaaatgctttccaagagttcatcaaatcctgaagcatggatttgtatgctacagcaataaacgaacttatttctctttggcaaaaatatgttgattgtaatggttcctattttgattaataaagatgtgttttgctttattttcttttgtttttttttgttttttgagaaggagtctcgctgtgtcacccaggccgcagtgcaatggtgcgatctcagctcattgcaacctctgcctcccgagttcaagcaattctcctgcctcagcctcctgagtagccgggattacaggcacccgccaacatgcccagctaatttttgtatttttagtagagacaaggtttcactgtgttggtcaggctggtgtcgaactcctgacatcaggtgatccacccgccttggcctcccaaagtgctgggattacaggtgtgagccaccgtgcccagccaataaagatgtgtttaagcctagttataatgatttaaaattcacggtccaaaaccgcaattacttttgcatccaaagtgcctaacaaagtgcctagtacctagaaggaatgaaataccaaggaagaaacagcccctgatgtctgaaaagtgatctgacactcccagctaagccacatggattctctgttggacatttaaaaaatctcctagaacatctgtatcaaccaacgtcactctgagatcatgatgaagtgagacaaaaacaagatcacagtgaaacctgcaaaataccaaacacccgcccccctctaagctaacgtgagtgacttatgcttctctaccaatcaatcacagctttatccttagtctattctgtattctgtattgttaagattccctgggatagccagtcatagaattgcccccgctttctgacagcacccaatctagagaaaactctcacttctttagaccctcccccgaattacccaatcaaagcccaaatcctataatagattctttctaccagcttcttactgaaatgcctcatacttgtctagggtgaatcttttccctcacttcaataagtaataaacccaatttgttcaactataggtgtattctggtggtctttgttcaaagggcattaacaacagatatttgttgaatgaataaatgtatgagtgagtgaataaatgaatctttttaaaaaacacacagttccccgcacatattagatagatgcccaatacattgagtcaccagaaaacctccttgaagatcaaagagtctgaaaaacaatgccagcatttaagctgactgaggttttattttgtcacagtgccataacagtctcttgaacagagtgcgcatgcaacaagtattagttatttgtgaataattgaatgttggacccaagaagaccagcatcaatattatggtgattgatggtcaccatgcctagacttatgacttgtacttgagggttaggcattgaataacagaatgagaagagcacaggccctgggtccttgtcctgccatccaagggaatccctcagccagttttggacagagcaagaagtggggaacctctgtcctcagcctggacatcgctaccttgaaagggatccatgcacttcttctgacaggcaaaaaagcagcacttctggtattccttgcagtcaaaatctgtgttacatgagtccggaagttcagtggtacaggtgagcctctctttgggacataaccctggtttgtctgcaagaaagaaatgtccaaactcacattctttcggaatttcagctctttttctcctatggcaaaggtgtgtagtgaaattctctcagccctatcctctaccttcgattcttagttcttgctctgcttatattcaggggctagttctgtttctcagcactcagattcattcaaatggatctgaatcaggaatttgtgtccaagaagaactgaaggagaagcatgttggataccagggaaaggggttagaaagggaccaaggccctttccctaaattcaaaagattttctctcttcttgaaacctaatattttaatgcttaattcctttgtctccagttgataaaagaaattagtaaagactggtgggaacatcatggaagtagaggtcaggagggctgatttgacccttgactcctggtaaactcaagaccaatctgaactcattgtatgatttttaatttacctctaaggagtaagaaacagtggagtggaagaagcattgtagtcaggcagacctggctcgggagcctggctccaacactaaccaactaaataatcttgggaaagtatttcccttcatctgagttatattttccatctttaaaatgagaatgacaattcctgccttacaggctgattataagagttaaatggggtgatgtctataatgcctggggtaagaccttggcagatgtggcgttgctttctaccttttatttttatttttatttttttactaaaaactagaagaggcaaggggaaaaaaactacagcacccagtgtttccagtcagtctcccatccaagtactaaccaggtctgatcctgcttaccttttgagatcagacaagatcaggaattttcagggtggtatggccatgcttccttcctttttaaggctagacatggcttcctgatttcagtgcttgtggtaggtagaatctaaagttgcaccctcaagattcccatcttctgattattgaatcaaacactaagctaggcaatgctgtgaagggattttgcagaaaaattaaagacccaagttagttgactttaagattagagattatctctaattttaaggtctaatctctggcccagacctagtcaattaggtccttgaaaagcagagttttcttctggttggtagagaagaattgattagagagattcaaatgatgagaaggatccaacttgctattcgtagctttgaagatggttgaggccaagtgccaaggaataagggtggcatctagaagtgacagccagtaaaggagcctcagtcctacaactccaaggaaatgactctactacaaccagggagcttgggagaggacagtgcatcccaaatgagaactacagccctggctgacatttcaatcttggcctggtaagacccggagcaaagaacccagatgcacaatgccagacttctgacccacagataatttgttacgtagcaaaggatagctcatacagcgcttaatgtgtctccatgattctaaactgagcatccctccagtggaatctggccagagaggcatgatcctttcagatactactgagtcttggaactgtagaactttggaatggaaagaactctatttatcattggtaccaaacttctgatttcatagatcaaaagtaatgaggtcagataggataatacaatgcattaggggcaagtctgggacttacaatccaggactcacttcaggagccccacgtcttccctgaggactggccactgagactttgagtactttccaacaatacttcttgtcattaatgaccccctccaggaatggactgaagctaagaagagtatgtggttcctaatttggagtgtacatcaaaatcatctatgcatctttcagaaaatatagactctaggctgaatcagaatctctagaaagtgcatccttgggactccactttttaaaaagaaccccaggtggtcctaaagcaggcagtgggctccaggagataggctgttacttgggaaccattgttctaggtttaggcagagacagagttcggcaaatcaaactgggtttgagttgttgtagctcctttccccattgtcagcttgaactctcacttattaataaaaaccctcctccgtttcttgttggctcttcttaaccacttacttgtgtgtataagcatacctcatgggtttctctgcatctactggggatgcttctcagagatctggtctcagctgtcttctgacattacttgacacatacttcctgggtaatcccactcgttcccacgatcccaactatgattcccatctcttcctccagactcatcctctattccaaactaaagacttttatttcgacctgcctgggaaaaacaccatctgggcatctcagaagcacctctgttccaacatatttaaaacagaactattatcttcttatgcccaagcactaccttactttctattccgcatcttgacatttggcatcaacaggtccagtttgttattagaatccagagattcactccttcctctccgccaccccagtatcccatcactcatggacttgggtcaattctgtctcctaaacctctctccaaaccctgtctcctgcctctctttactaccactccctcagatcagcacctgatctcaccccttgtctcttctcaactactgcagcagcctcctcactggtcctctcccctcaggctcatgcctagtgacttattaattaaaaaacaattaaacttgcgtgtgtgtgtgtgtgtgtgtgtgtgtgtgtgtgtgtacagtgggaatgaatgtaatcacccaagaattatgtgttgagtgatatcataagacagatgagaccagatctctggggatcatccctagtagatgcaaactatatatatagtctccttacatatataaaaatatggaaaagttagggaaataatttggggggagcaagtaaggaaagtatgtggagggccagggtcgtgagcaggggtagctttctgtggccccaaatccacagtagagggggcctcatctgacactggcactggcctcatgtctaaccctcatccccaataatgctttctaaggaagaatggctgcagcttttttgaactcacgtttgatcttcttggtcagcattgcagaagtccactccaaagcaagggagagaagcagcaggaaagctacattcctccaggagaaggtggggctatggagaggaaagtgcctgtatggatgagaagagaggtgggagttaagcacaatccagagagagacacaaagtgtgtgcaggggaaccttagagatgatccaccaggtccctttagttcacaggtaagaagactgacaccagcatggggaaggagtctgtctgaggtcagatggtgagttaaggtgtgtctaagacattccgtttcaggaccctgaccaatccccataccctgccatggtgctgtaccttgtgccacacagacacttgcctattgtcttgttcctgggtaaaaggccacacttgaatgatcacaaggatttatttggaacagttgcagagctggtttgcccacagtcactccaggggcaaccccagacactagtgagcatcttttctttgctccactgatgacagaaatggatggtatgagatttcccagagggcctgggcacactctactggatcttggtgcaccagaagcaagaacaatctcagatgaccttgggttaacagagaaattccttttattccttctgtgactatccaagcctaggatcttatgatactcccagacaaccagatgaacagatgagcttcccccgcctactcaagcccccatttcccatatgtgtcttcatgatccttatgtattttttattttaaggtgtgaaaaactaataatcctttactgtattaactcttagagtgcatgcatttcaaaaatgcaagaggtgggtagagggagaaagaggaagcaagagacagagaaaacatctttatgccaaaatatacatctgtattggtggaacttccgatactgagaaagctatgaaggtatcttggaatagagtatcttccagagttcctgaagccataccatgtggctgcctaaaagtaaagacttgtgacaatttatctccccaaccttttttgttgggggagttctaatcatgtatcctcttcaaattttacaatagtgcctatactctctggtcatggaaattatgaccccaaacatagtgatcttgattttgggcctcgctcaatcccttataacagcatatcttggatcctcaatttcctcatctggaaaatgggaataatacaattaacctggaagctttgttgtcattgtgaggattaagatgagatagcatgaagatttaatgaagtggtacggagtggtaggaaacgtagcattcagagttagacctgagttcacatcctgaatccaccacttatcggctgtgtggcctgggttcagtcacttcacttcactgagcctcaatttgtcataaaggaaacaataataacacctacctcacagacatgagaattacttgaactatttttgtaaagcatgacaagtggcttgtaaatcagtgtttattgtattttagccagttaacaaataatgaatggcaatagtgaatgccaacaaatgttcctattaccattttagcttttgagttccctagttagagactgtgtaaatcattcctttagttcccctaaaagattagccaaaaggccctctggtgctttaaatttttattatcaagtcactctatgggtttgaaattttaccctctaacctgaaaacatctattaacccagtcttgagaatcagttaatcagattagcctgcagtcagttagaagaaagcagatctcgtgggatggaggcaggggagaaacacagattaatagaattgccaaacataatagaggatgtccatttataattttagcataagtatatcccatgcaatataaggaacatagttctactaaaaaagtatttgatgtttatctgacattcaaatttaattggtcatcctctatttttattttctaaatctggcaactttgacacagaatgaatccattttggttggactggggtttgtttgggcaagagactacaaaacacaggtcttataggtaacaaatgagcataattgcaagagttgctcagtgggggctctgaagaactaggacagacctggaatactaggacagacctggaatactaggacagacctggaatacacggacacaaatgtgctatataaataacacactaggttctgggcacggtggctcatgtttgtaatctcagcactttgagaggccaagacaggaggatcacttgagcccaggagttcaagacccacctgggcatgggctgggtgcggtggctcacgcctgtaatcccagcactttgggaggcccaggtgggcggattatgaggtcaggagattgagaccatcctggctaacacggtgaaatcccgtctatactaaacaaaatacaaaaaattaaccgggcgtggtggcgggtgcctgtagtcccagctattcgggaggctgaggcaggacaatggcgtgaacccgggaggcagagctttcagtgagccgagatcgccgccactgcactccagcctgggcaatagagagagactctgtctcaaaaaaaaaaaaaaaaacttagcccagcatggcagcgcacacctgtggttctagctacttaggaggctgagctgggagaatcacttgagcccaggaagtcagtgtttcaatgagccatgatcatgcccctgcacttcagcctgggtgacagagtgagaccctgtggaggaagggaaaggaaaggaaaggagagaagaggagaggagaggagaagagaataggggagagggagaaaaaagaagaaagagagagtgaaagaaaggaaagaaagaaagaaggaaggaaggaaggaaagaaagacaaagaaggaaggaaaaggaaaggaaaggaagaaagaaagagaaagaaaggaaggaaggaagaagaaaggaaggaaggaagaagagagagggagggaaaggaagaaagagaaagagggagggaaagaaggaaagaaggaaggagagaaggaaggaaggaagggaaaaagggagggagggaaggaaggaaggacacacaccaggaatgaagagattttgattgaaatccacgcttcaccatcaaatcactgtgtcaacttgggctagttttacctccgtctacccatttgaaattttacctccgtctacccttttgaaaaatgagtggatttgactagattaggcttgttcaggctggggtacccatatccctcaggatacaggtagattttccaggaggtacacaggtacagagggatctgaggacattactgattattaaactacatatttactttttcctgaagttgatttacttgacaatgagccaccctgaagttctccttttcttcttctctttgattaagtccttcctctttaaatttttttttaaaaaaagcatacttcttacatatctctcacatgtcttcaaagtgtaaaaacttctgaattccaaacaaaggaacaattcaagaatgcattttcctgaggatgctttccatggaagcaaaggaaagaaagtgtgagtaagaaataccaaggggtcagcaccggtttcattcaggtggcaaactcacactaagccactgtgccttttgctgtctaccctagaaataggattcaggagtgtgatagttgccacggggatgtagattaagacattgatttgaattgaaaaatgaagacattcttttgtgggagaaatgagtttgactgatttggctgatggaggactgactttgccaattagttaaatctgtgccatcaagttttttaaaaaatatatttaaagtatgcagtaagataaaagcattttatgaaagtaatcacaaaattttaaaaaaatatattttttataaaatgctttcaaactttcctatattttgaaaccatagtattcaaactttccagcacttacagagcatttcagattagataaggtcactaaatgaaagaataacatgtataactaatcacattattaatcgtttggtagatgctggtaaagcctttttagttaactttctggaaattaagaaaatcacttgtgatttgtgattagtattctaccagctaaaaaaacaaatccttttgcaagataccaggtgtccaattctatgactttataaaaattgaaggagtgtttaatcaagctattgattaataattaaattagatcattaaaataatttttaaatgcttaatattattttaatataatctcttgagatcaataacatattgctagccaggtgcagtggctcatgcctgtaatcccagcattttggaaggctgagtcaggtggatcacttgaggtcaggagttcaagaccagcttacccaacatggttaaaccctgtctctactaaaaaatacaaaaattagtcgggcatggtggtgcatgactgtaatcccagctactcgggaggctgaggcaggagaattgcttgaacttgggaggctgaggttgcagtgagccaggattgcaccactgcactccagcctgggcaacagagcgagactctgtctcaaaaacaaaaaacaaaaaataataaaataaaataaataacattgcaaaatgttctgcagtagaagtgcattcctaaataagtaaacccaaggcaatagttgacaaaaaggcaaataaataagtaactttagtttaaaatacagtcaccctttggtatctttgggggattggttccaggaactctcatggataccaaaatccttagatgctcatgtcgcttttataaaatggcatagtatttgcatataacctacattcattcttccaaatactttaaagtcacctctagattggtaggtatttaatacttaccattataaatgctatgcaagtagttgttatactgtattggtttttatttgtattatttttattgttgtgttattttttattgtttttttctaaatcttttctatctacagttgattggacctgcagatgcagaacgtgtggatatggagggccaactgtaaatgccaaaaaaaaatcaactttacaaaatagcgttatcaatgttaactattttcaaatacaagtagggactgaacatatatgcatggaatcatgttctcattcactgacataagtgtaagtgtgcctccaaacaagttactatgagggtaaatacataaatatattcaaaatacacacactcaaataataagccacagatcacccaccattttccaagaccaaaattttcacataaatataagggcaaatacagccaaataccagtgtaaattaacacgcttacatacacagatatgtgaaaattccagaattcaaagtgacatgcagacatgtaacacaggtgtttatgcataaacacacagctcggtcagaaacggcccatacagaaacagtggtctactgaaacacagaatactgctgtgaccttctcactagcgatgaaaactcaacagttcacgataaaactgacttttaaaatgctcatgctttaaataatagagacaaaggaaccagacttctaaagccactctccaccgccactgaatttcttataagttgataatgtgaaggcaatttcaaaaacgtaaaagcacagggaggttggtgactcccatctggaataaagatttgttaaatgaaatcactgaaattgaacagagaaacattctgtaaagttagctaaatcatttttaccttttttcttgttagagacagaacctcactctgtcactcaggctgcagtgcagccgggccatcctagctcactgcagcctcaaacttctggactcaagccatcctcctgcttcagcctcctgagtagctgggattacaggcatgcaccaccatgcatggctcaaattctttttactgtgaaggccctgctagagacttgctactgctctagttcacatcttgtagaggcaaaactaaaaaagctgttgctgtgcgcaggtgctgtgggagaacccaagaaaaatggtctgaactgaaaatctccatttccactacccaatttccaactggtatactgtccacagaaaatttggagttgttccctaatgggaagccaaaaacatcagagtacaatcatggatggctcaagggtatctttgtggtgtggaatagtgatgtttcatagcctaagcctgtcatagaggccttggagctttcaatactgatgattgtgcttcataagtgtctcagagaagtcactgttatttttttcttgtattcttctagcactctcctcatggaggttatctcccttttcacagaggtcaattcaacatcctggctctgtatttgctgagtgtatgtcttctccatctgtttcatatggccttcagctttcctgaaattgtattcttgatagagacacacctgatgtaatgtccagaaggccaagtacttgggagctaatgcccaacactatctccagtcacagtccagccaataccatagctttatattcctgaattcagtgcggacaatatctagccttccagaaagtgtactgttgcaggcaggacagatagcaggtgaaccacaaaagtcaccactgccatgctgatcacagaagatgtgagagcagatggtgacccatgcataaccagagagttcaatgtgacactctcgataattacaaaacaacatgtcttcacacaaagacataataggatagtgaggtctccagatgctgaaaatagtccatgaaagaaatatgcagtcatcatccattgtatatctagaatttacagcactgaagaggaccagactgaaacagtaagactcagatctggttttggccttgaaattttacttctctggtatcagatgaatccagcttctatgtaggtatcaagttgaactacaggatctatcagctacttagcatcatctctttatagtcacatcagcctttaactcttcctttattgagaatttccaaatccaatcctgcttgattttcagggggtctgcagatgacctttcacagggccacttctggcctggcacacagggtgctaaagacccaggtcttacctcttcagtggatttcatcttcaacctgccatccttctccctttaggagagggagggttaaaataatttttgattatgagtatcatgtgatatttggcaacttactagaagttcaaagaaccaaatgtcatacttaaaactttttgtccctgtacacttacatattaaaagatgaattcctatagatttgtatttatcaataaaattgtgtttctcaatttttacaatgtgtttatttacatgttcattattattatatcattgaaataacaaatggattttaaaaattaattcataagaaaaaatttgattcctggagtctcatggtcacagtaaataatttaaattttaatttatgcatatgtttttaattgcatagcagtaggaaaatagcatgaatggcattgcctaggttgtctttcaggatttttatggttttgggtttaaaatttaagtctttaatccatcttgagttaatttttgtaaattgtgcaaggaaggggtccagtttcagtcttctgcatatggatagccagttatcccatcaccatttattgaatagggagtcctttccccttcacaatagcaaagacatagaattgacctaaatgtccatcaatggtagactggataaagaaaatgtgatacatacacacaatggaatactatgcagccatgaaaaagaatgagatcatgtcctttgcagaaacatggtggagctggaagccatcatccttagcaaactaatgcaggaacagaaaaccaaataccgcatgttctcacttataagggggagctaaatgatgagaacacatggagacatagaagggaacaacagacactgaagcctatgggaggttggagggtaggaggaaggagaggatcaggaaaaataactaatgagtactaggcttaatacatgggtgtcaaaacaatctgtacaacaaacccccatggcacaagtttacctatataacaagtctgcacacgtacccatgaacttaaaagttaaattaaaaaaagaaaatgacatgaataaaagacttctgagcataagattatattccattatactgaaagtctggggggtaagaggaatgaaaatatgagttcaatgaaaaaaattaatgttttaaattttctaactgttaaagaattgctttccatatattttaaatagatgcttgtgggtatcaaattagtatatttctaccccagtgattatatatattttaaaaaattatgtagcagtttaaaaaattaatatttacatgttcacataatgcattgagattcatttatgttgtgtgttgtttgttcttttttattgctgaattttgtccattctatggctatacaacaggttcatcctttctcttgttcatggaaatttgggttatttccagtttggggcaattatgaatgaagcccatacaaacattcgtatagaggtatttttatgaacctaagtattcatttctcttaaataaataccaggaagtggtattgccgggttatgtgaccagtgtatgtttgtaagaaactgccaaactcttttccaaagtcacagtaccattttgcattttcattagtaatgcatgcactactctcctaagagttccacttgctccacacacctgttagcgtttggtattgtaaatgcttttattttagtcgttctaatagatgtgcagtggtaagactgcatgctatttggagaaatgaaagtaattagcctacatttgtggaactctaagaatctaagccacttcaaatgttggtgggaagatttttcgtattttccaacttctcctaggacagctttcaaatccagttggttccttggtttctgagcctgcttgggtaggagtttctccagagccccatcattgaacctactttaaaaaaaagtcttcataatttccatactttattgtccttaaatcgttaattttaagtttaatattattccttttttattttccatgtctgattctctacccacaatctttttgttttcattagattttatttgcctttctttttccaacttgaaatggatcattggtcaatttcattcatttctcatttcctataatttacttccatttttatttttaatttgagacatacctctttcatcactgctttcattgcactttaagaaatttattttaattgactaataataattatttatatttatgtgctacaatttaatgttttgatgtatgtacacattgcggaatggttatatcagggtaattaacacatccatcacctcagatacttatcattttttaaattagaacatttctgtagcaattctgaaatgtacaatacattgttaactatggtcaccatgctatgcaatagatctcagagacttctttcctttgtctaactgaaactttatccccttaaccaacatcttccctttccccatacactccaccctgacccctggcaacggcctctgataaccaccatctactctctacttctacaagttcaactttttagattccacatgtaagtgagacatgcaatatttgtctttctctgcctggcttgtttcacttagcataatgttcttcatcttcatccatgttattgcaaatgacagaatttccttctttttaaaggctgaatagtagttcattgtgtatatataccacttttttacccatttatccattgctgaacacttaggttgattccatatcttggctattgtgagtaatgctgcaatgaacatagcagtgccaatatctcttcaacatactgatttcatttcttttggatatatacccaaatatgggattgctggattatgcagtaattctacttttagtatttttgaggaagctccacactattcttcataatggctgtactaatttatactcccaccaacagtgttcaagaattcccttttcagccaggtgcagtggctcacacctgtaatcccagcactttgggaggccgaggcgggcggatctcatcaggagattgagaccatcctggctaacgcagtgaaaccccgtctctactaaaaatacaaaaaagtagccgggcgtggtggcgggtgcctgtagtcccagctactcgggaggctgaggcaggagaatggcgtgaacccaggaggtggagcttgcagtgagccgagatcgtgccactgcactccagcctgggcgacagagtgagaatccatctcaaaaaaaaaaaaaaaaaaaaagaattcccttttctccacatcctcatcaacacttgttatgtttaatctttttgataacagacattctaacaggcatgaggtgatacctcattgtgattttaatttgcatttccctgttgattaatgatgttgagcattttctcataaacctattggctatttgaatgccttatttatttatttactaacttacttatttatttattttcaagacagtcatgctctgtcacccaggctggagtgcagtggtgtgatcttgtcacactgcaaccttcgcctcccaagttcaagcaattctcgtgcctcagcctcccgagtagctggaactacaggcatgcgccatcatgcccagctaatttttgtggttttagtagagacagggtttcaccatgttggccaggctggtcttgaactcctggcctcaagtgatcttcctgccttggcctcccaaagtgttgggattacaggcgtgagccaccgcgcccagcctttgtatgccttcttttaagaaatgtctattcaagtcctttgcccatttttaaattgagttgttttcttactatcaagtaaatggagtgccgtatatattttgaatattaacccctcatcatagtatggtttgcaaatattttctctcactctatgagttgtctcttgactctgttgattattttctttgctatgcaaacgctttgtaatttaatgtaatctcacttgtctagttttacttctgtttcttgtgattttagggtcatatccaagaaatcattgcccacacccatgtaatggagctttccccctatgttttcttctcagagttttatagtttcagccattgcagttagatcttttgtccattttgagttgatttttttaaatatatgcatattttgtatttcaatagcttttggggcacaaatggtttttggttacatgaatagattgtatagtggtgaagtctgagattttagtgcaccagtccccaagtagtgtacattgtacccaatatgtagtttgttttatccctctctgccctcctacactccgcccttctgagtctccaaagtccatcataccacctgtatacctttgcatacccataggttaactcaacttataagcgaaaacatatggtatttggttttccattcctgagtttcttaacttagaataatggcctccagctccatccaagttgctgcaaaagacattatttcattattttttatggctgagtggtgtatatataccatgttttctttatccattgagttgatttttttgcatggtgtgcaataagggttcaattttatttttctacatgtggatttccagttttcccaagaccatttatcagagacagtctccattgtgtgttcttggcacctttatcaaaaatcagttaaccataaatgtatagatttatttctgggctttctattctgttccattggtcaatgtatctgtttctatgacagtaccatgctgttttgattgctacagctttgtagtatatttaaaatcaggtagtgtgatgcctccagctgtgttctttttgctcaaggttgcttgagattcttggggtcttttgtgactccatacaaattttaggattttttaaatttctataagaaatgcaactggaattttggtagggattctgaagttatacactaacaagtggaataacctggaagaaattgagaaattcctagaagcatataatctaccaaaactgaatcatgaagaaacagaaaaactaaatagatcaacaagtaaggagatttaattggtaattaaaagtctcttatcgaagaaaaatctaggatctgatggcttcatgacttcattctaccaaacatttaaagaactaatgctaatcctcctcaaatgcttccaaaaaattgaagtggagggaattctttcaaactcattttatgaggccagcattattctaataccaaagccatgcaaagacactacaagaaaagaaaattacaggccaatatccatgatgtacacagaggcaaaaattctcaaaaaaaaaaaaagatcagcaaattgtattcaacagtacattaaaaggatcattcacagccaagcatggtgggtcacacctgtaatcccagcaatttgggaggccaaggagggcagatcacttaaggctaggcgttcgagaccagcctggccaacagggcaaaaccctgtctctactaaaaatacaaaaaaaattagccaggcatggtgacacatccccataatcccagctacttgagaggctgaggcacaagaattacttgaacctgggtggcagaggttgcagtgaaccaagatcgtgccgctgcactctagcctgagtgacaaagcgagactctgtctcaaaataaaagaaaaaaatagtatcatttaccatgatcaagtgggatttatcccttggatgcaaggatggttcaacatattcaaagcaatcaatgtggtgaaccatcttaacagaattagtgatataaataatatgatcatctcagtagatgcggaaaatgcatttgacaaaattcaacatttttatgataaaaaatctcaacaaattaggtatagaaggaatgtacatcaacacaataaaggccagatatgacaagcccacagctcttatacccaacagtgaaaagttgagttttttctctgagatcaggaacaagacgagaatgccaatttctaccacttttaatcgacatagtactgaaagtcctggccagagcaattagcaagaaaaataaataaaattcatccaaataggaaagaaagcgacgaaattgcctctgtttacttatgacatgatcctatatatagaaaaccctaaagactccacaccaaaaaaactgttagaactgataaagcaatttattaaactttcaggatacaaaatcaacatacaaaaatcagcggcatttctatacactaacaacaaactacctgaaaaacaaattaaaacaatcccatttacaatagcataaaaaatacttaggagtaaatttaacaaaggatatgaaagatctgtacactgaaaactacaaaatattagtgaaagaaattggagaagacataaataaatgaaaagatatttcatattcatatttcatatggattagaagaattaatattgttaaaatgcccataccacccagaacctatctttttgcccagcttccccaaatagcagaggttgcactttgcaggaaactgagcagcattttgcaattgaaaggtctacagatggccaggagctgggggagcagtgtgaattcccaggttacaatatttaggaactacaggtaagggcccactatgactctattacatctcgctaccctctagttctccccagttaggcgcttgcccagccccaggccctgtttccatggctgagagctcctagctcacacccctcctcatccccatagcatagcatgttctgttgcaaggctactcaaccagatatgtgcctctagcctcagttactaggaagcagaccttgaggaggacaactagctccataagtcactttaatacaccttgccctaagttcaggctgagtaagtaagtaaattagtaagcctcgtccaaagatattttcttctaaatgctgcctagtcagatatctacattctgataccggagaaggattgtctctaaatattgagtacagaacactccgtacatatctccatattgtgctgctaaaatattttaaatcttttacattttttgtccttttgatctgtcaatgattgagaaaggtgtgtcaagggccctcaatacagccatagatttctcaatttatgcctataatgatgtcaatgtttgctttaatatatcctgatttgattggtttaggtaaatacaaatgtattcctggtgaactgagtcttttaccattatctagcaagccatcctttatccttaaagataaaacttcgtcttagagttttctttttttttttcagacagtctctcactgtctttctcccagggcggagcgcagtggcacgatcttggctcactccaacctccctctcctgggttcaaatgattcttgtgcctcggcctcccaaggagctgggattataggcatgtgccaccacacctgtaatttttgtaattttagtagagacggggtctttccatgttgcctaggctggtcttgaactcctggcctcaagcaatctgcctgcctcggcctcccaaagtgttgggattacaggcgtgagccaatgtgcccagccttagagttttctattgcctaatattaatcaaactatactctctcttctttgtttgcatttgcctagtcttttttccattcttttgcgttcaaccattctacttatgttttaagtttatccttcaaatcgtgtaaatctacattgtaaaaatccagtccagaaattattacctattaattgacatttatgggcactaatgacatatttggattcatttctacaattttattacaagttatctactctcagtcctcattattcagattctgtacttgccaatttgcctacttgctgaaatttatttattacccaaaaatcaatactcatgatgcttttgtggtcattcagggatatgtgcagaatggcaaaaaatttgagtcccccaacgtacacattcccagctgaagtcaaacaaggcaacgctctgcttgtttaagctcttctactactataaacaagcttcctttttgcagtctacttagtgtcacatttttcacatttttgtgctttttgttggtgagtttgctgtttaaaatggctgccaagaattactaaagtgctgtcaagtgtcctaagagcaagaggcctgcaatgtgccttacaaagaaattacttgtgtcagataagcttggttcaggcatgagttacagggctttcagccacaattcaatgttaatgaaacaataatatatattacataaggtgtctttttttttttttgagatggagtctcactctgtcgccaggctagagtacagtagtgcgatctcggctcgctgcaacctccgccttctgggttcaagtgattctcctgcctcagactcccgagtagctgggattacaggcacccaccaccacgtcctgctaattttttgtatttttagtagagatgaggtttcactgtgttggccaggatggtctcaatctcctgacctagtgatccgcctgcctcagcctcccaaagtgctgggattacaggcatgagccaccgcgcctggcctatatacatgtttaaaaaataaagacagggccagcacggtggctcatgcctgtaatcccagcactttgggaggctgaggcaggcagatcacctgtggtcaggagttcaagactagcctggccaacacggtgaaaccctgtctctactaaaaatacaaaaattagcctggagtggtggtgcacacctgtagtcccagctactcaggaggctaaggcaggaggatcccttgaacccagaaggtggaggttgcagagagccgagatcacaccactatgctccagcctgggggacagagagagattccctctcaaacaaaacaaaaaaaataaaaataaaaataaataaataaataaagtatgtagagttttatttaataattaaccacacagattaaaaaatagaaagtagccagcttcccagaagtcttctgtgtgcaccttctaattaccatctctgtcatgtgtcttcagacagaagcacatataaaaacaaggttatgtattgatcaaatgatgaaaatgtgtggtcagaggcttgcattttccctaggagcaatggctcagtatttgctaatccggtgttcacagtgactttacagaacataactacccccaagtaatgggaatcaactgtatttttattactttggtgtacaaagaactttgagctctccatggcttgccacaacaaaagacttcctaggcaaattgtctactgctttgttccaagtgggggctctacttgaggctgtgggaccaagacaaaagaagcagcctctatgtggattaggccccttctcctggcagagagaaagcacaaaggagctggcagaaactcacagtgcaaaactcactatgcatatgctacatctgctcatactccaataggcaaagcacagctgacagcaaacccaaagtcaatgagacagaaatgtgtcttccttccacgggccgttctaaaattgcaaggtaatggacaggagtgtcctcttaaaggaaagatggaatgaatagttgtgaataataatataacccatcactactactcctgttttaattttttgaaaatgtttagatacatattatatgcttgtttaatttaaaatatcaaactttaccttgctcaggctctgcccctccacactgggccactcaaagatgcccaacttaccctacttgggctccaacagccatatcaggttgcattcgagaccagcctggccaacatggtgaaaccccgtctctactaaaaatgcaaaacttagccgagcgtggtggcgcacacctgtagtcccagctactagggaggctaaggcaggagaatcgctggatgcattgatgccctcttcaccctgcttaggctctgattcctgacacaagacagctctgttctgtggaacccctcctcactatgcttggcccaactccccacagccgaccactctaacttctatgtatcctcctcatctccttgggctcagaccctccatgtctggctacccacccccatagacaccctcctcaccctccttcagttcggacagtccacatcaggcctcttccctatggagacagcttcctcactttgctccagctctaaggctcctccctcatctgctcccctgcctggacactctgctcaccccactcaggctctcattctatgccagtctgcccctctagccccagggggatgcctttctcaacatgggcaggctggtctccatgctatgctgcttcttgcctcttcactgggcattctcatctacccctggctccagcacaccaggccagcagccctcctacagagacaccctccttgacctgttccagctctgatgcccacacggagccagccgtggctcccttccccttggggcaaacgcctaccttgctaaatgtgcctatctaatggctttaggactgactagttcagttagtaaagaaaaggagacaaaacaaggaagagctacttttcctttttgtaaaaatatgtattgtgaaaaacaccacaaaaataaaaatatgcatgaaacattaatgttcagtctaacgaactattacgaagtgaccactcattaaactatcactgaaatcaagtaaaaaatttccaacactttctgctcctttttcattcttttccagtcacaaccccttcctatgctctcaaaggcagctaatggtagtgactttctttttcatattttcaagatcatatgtattcccctaaatatgtttttgtttttgtctgcttctgttctatatcaatggagtcacttggaatgtattcttttgtgcctggctttttgtgttcaacattatattaatgaattccatccacattgttttgtgtagctgtattttgtcaattttcattgccatgccatctattgtatgactacacacatctctactgagttgtttatagtttgcagctgttaagaataaagctgctgtgtgtatacatagcatgtatgtaataacgttctgcacgtgtatcccagaacttaaagtataataaaaaactaggattttctaaataaaaatgttatttatatcaacatgtaataagtttattacgttaaatgaattaataaatgtttttaaatgtcaaaaaaattttaaacaatttactcatgtaaaaaaaagaataaagctgctatgaacactctgtgtgcatttgctggagcacgtgggcaggtgttcttgtaggttatacattcagcatagggaatgatgggttacagggtatgcatatcttcagcttctcaagctgataccaaattatttcccaaagagtttgtaccaattcacagccttgccattggtagttgagagttcctattgttccataaccatgctgtatgtagaactgtcacaatcttttcatttttaccatcctgctacgagtatggaaatacatcactgtggacttaatttaaatttcttgactactaatgaggttgagcacctttttagatctttattaaccacttggctatcctctctttgattttcttttcaaatgttttgctcattgttctctggggttttctgactttttcttgctgatttctactggagtcatgtctttcctcagttatatgtattatgaacatcttccaggatcaagggtaatcttctaaaacccttattggcttgtcttttaccttttgaatgaaagtttttatcacgtgcccttcctaccccaaagacagaatcaggaatcctttttctatgttcctttcctacaatacaataactcgctacaatacaatacagtaactccaatatctgaagtctttgtggacctctgctgttggttgtttttcttgatttttttcatcttgttttcttaagatctgtgtgattttttttattgtgagagtacatatttaatggaagtttatgtatgtaacaatactttgtggaatttcttggattcctgtgtttaaaggagaattcttccgaatcaacttgtcctcaatttttccctaacaactcatgcaattttgaattaaattcatagctttagatttatcagaccatgcacatgtgccaattttcctactctgctcttatgaaaggaaacaaggttgcagttacaaattctcagaatagtctttttttttttttttgagatggagtctcgctctgttccccaggctggagtgcagtggcactatctcaactcactgcaacctccttctcccgggttcaagtgattctcctgcctcagcctcctgaatagctgggattacagacacgcaccaccacgcctggctaatttttttgtatttttagtagagatggggtttcaccatgttggtcaggccggtctcgaactcctggcctcgtgatccacccacctctgcctcccaaagtgctgggattacaggcatgacccactgcacccagcccagagtagtcttttttcctgttttgttcagagccaaagccaagacaggcaagttccttcaccacagttgtgcatgtgtgtgtttctgtttcatccatttatttctgtttcatccatttattaaggtgtcagcatttggtgatccttgtgagtgagatttctgatctgacttttcacattgcttagggcttagctcttttttcttgcccttgccaggggcccactaaaattcaaactgcagattaccaggcattggcagatactcccagggaagcctctaactaaagcacttccttatctctctggagtcagaccttcacatcatttttggcttttaagaattcctctttcttgccaactgactcattgatttaaagagtcatgcattttaagtattttagacaatattttgggggggtgatttactgggaatagtttctaagagtcctagttatgaatttttaattataaaattacacacatcaaatacccaataagtgaaacagtacaaagaacatataaagaaaaggtaataatttctaagccacatctctccatttctaactccctcaatattaatagccttggttgataattaataaccaattttaatgggctgttttgtacccttaccatctttctctgcgtccaaatatatacaatcatgtatgtatatgggttctgatacttggaaaacaaaatgaaattatgatgtatacattcactactactgtacttgcttcttttcacttaactctacctcatgtaagtccatccatataaaaatgtagattgaaaattgccttaaatagatgcccacactctgttcaacatctctgctcttaaattactgctagtcttatggaaattgcagagttgcttaatttgcatatccccaactactactgatattaatcttctttgctttttaaagttttttagttaaaaaatttataattgacaaataattttatatatattagtgtgatattttcatatacatatacttatattgtgaaatgattaaatcaagctaattaacatctccatcacctcacatacctatctttttttgtgacaaaaacatttaaaacctactctcagcaatcttcaagtgcttttaattatcggccatttgaattttctctttcgtgaactgcttgtgcaaatctttttctattgagatgtttgtcattttctcatcaatgtgtttattagaaaaaataacttctggctagtcatatgtattgcaaatatttccctcagcctgtagtttgatttttatttattatgtgttttgttctataaaaatttaaagagttatgtaatcaataatgcttattaatttttctttatgtcttacatttcttgcttaagaagttctctccaatgctaacatttgagatcattctcctaatttttctcctaagttatttatttaaaaaaatctaacacataggacagagatttctacttttctgggaaaatgaactagatggacttttctctattcctctgatgaaattcagctaaaaatcctggacattaaatacacaagaagattctgaaaggtaataagggcaaggcagacgagccagaaaccttaagacctgaagaacagcacggcagcgggattactgagttttctttttgcctcacatattcaagactgggtgctagagaagctggaaacccagaaacacagaaacagagacaataaaagcctcaaaaacaaaacaaaatgcaacacaacaaaaaaccagcctgctcactcttgccaaaggaccaggaaagaggcagcctaataagacggaaaacattgaacaataaccactagtatagccaaacacgtagttccacccccatcagagctgagagaggagcctcaacttctgcctttaccaggctgaaaggaggagccccagtctccctgcaaagagcccagactttggtcaccaccagacagtaatgatgctgccttcccccaatgcgtgtgctgtcagtggaggccgtgtggggagcagaaggatacttctatccctctctgctagagaggtatcagtggaacttattgaggagctagacctcccaccccagcccagaagtaatgagaggaaaccactcccccaactcagttgtcaacaaagactcaatggggaacctgatttctacccccatccggcagtaatgaggtggtgctccactcttccctgctggaagggtgacagaagaaatcaaggtttaaatgagatctagaatctcataaaataaaacccaaagtttccaactttcaatacaaaattatttgttatatcaaaaaccagaaaaatctcaaacaaaatgacagaagattattaataggtgccaacactgggatgacaacgatgttataattatatgataaaaattgtaaagaggtcatcataaagaagcttaaaggagcaattataaacaaacaaagatattaaaacagaacgtctcagcaaagaaatagaagatataaagaagaaacaaatggacattttagaaaattttaaaagcgtataactgaaatacaaactcaatggatgagcttaacagccaaatagagagtatagaggaataatctgtgaatttgaagatagaactttcactcacatccgtgtgaagagaccaccaaacaggctttgtgtgagcaataaagctttttaatcacctggatgcaggcgggctgagtccgaaaagagagtcagcgaagggagataagggtggggccattttataagatttgggtaggtaaaggaaaactacagtcaaagaggggttgttctctggcgggcaggagtgggggtcacaatttgctcagtaggggagttttgagccaggatgagccaggagaaggaatttcacaagataatgtcatcagttaaggcaggaacaggccattttcacttcttttgtggtagaatgtcatcagttgaggcaggaacaggccatctggatgtgtacgtgcaggtcacaggggatatgatggcttagcttgggctcagaggcctgacattcctgtcttcttatgttaataagaaaaataaaacaaaatagtggtaaagtgttgggaaggcgaaaattttttggggtggtatggagagataatgggcgatgtttctcagggctgcttcgagcggcattaggggcggcgtgggagcctagagtaggagagattaagctgaaggaagattttgcggtaaggggtgatattgtggggttgttagaagaaacatttagaattattggtgatggcctggatacagttttgtatgaattgaaaaactaaacggaataagagaaggagaaaaacaggtattaaaggtctaagaattggaaggacccaggccatctaattagagaatctcctaataaggagattcagcatagtcctgccagcaaagattatttatttactttaagagttaagagtggcagtttggagatagcactaggagatatcagctgtgatggcttggagaaacagtgtaagccggcagtgtaaacatattgtctagtcctttttaagttagtggctgagcttggtgaggtgtgtttttaaaagacctttagtccgttctacttttcctgaagactgaggactgtaagggatataaaggtttcactgaataccaagagcctgaaaaactgcttggctgatttgactaataaaggctggtccgttatcagactgtatagaggtgggaagactaaaccaaggaattatgtctgacagaagggaagaaatggctgcggtggccttctcagaccctgtaggcaaggcctctacttatctagtgaaaatgtctacttagactaagaggtatttttgttttctgactcagggaatgttgagtaaagccaatttgccagtcctgggcaggggcaaatctctgagcttgatgtgtagggaagggaggaggcctgaataatccctgaggagtagtagaatagcagatagaacactgagaagttatttccttgaggatagatttccacgatggaaaggaaatgagaggttctaagaggcgggctagtggcttgtactatagcatagcctgcctttgctggtgtgtggtgattaggcctggtggaactaccatcaataaaccaaatgtgatcagggtgaggaacaggaaagaaggaaatatggggaaatggggtgaatgtcaggtggatcagagagatacagtcatgggggtcaggtgtggtatcaggaataatgtgggaggccggattgaagtccgggccaggaacaatggtaattgtgggagacttaacaaagagtgagtacagctgaaggagccagggagcagaaagtatatgtgtcaggtgtgagaaagaaaatagattctagaagttatgagaagtgtagagagtgagttgagcatagtttgtgattttaagggcctctaaaagtattagggcggcagcagctgctgcacggagacatgatggccagcctaaaacagtaaggtcaagttgtttggacaaaaagctacagggcgtggtcctggttcttgtgtaagaattctaactgcacagccctgcacttaggctttgggtaatgaaaagggttgggatgagtcagggagagctagggtgtgggcagtcactaaagctgtcttcaaggaacggaaagaggagtggggaaggatttaggatctatagggtcagctagttttccttttgtgagtttatgtaatggttttgttaggatggcaaaaccaggtatctaaagtcgaaagtatctaaccatgcctaggaaggaaaggagttgttttgtaggtgttggggtttgagagatcagctgaacacgatcggcagggagagcacgtgtgtttttatgagaattacactgagataggtaacagatgaggaagaaatttgggcttgactgaagtaatgggggctatctgtgaaggcttgcggcagtgcagcccaggtaatttgctgagcctggtgggtgtcagggtcagttcaagtgaacgcaaagagaggctgggatgaagggtgcaaaggaatagtaaagaaagcatgattgagatccagaacagaataacgggttgtggagggaggtattgaggataggaaagtatatgggtttggcatcatggggtggataggcaaaacaatttggttgataaggcgcagatcctgaactaatctgtaagacttgttcaggttttggacaggtaaaatggaattgtaaggagagtttataggttttagaagcctatgctgtagcaggcgagtgataacaggctttaatccttttaaagcatgctgtgggatgggatattggcattgagcagggtaagggtgattaggttttaatgggatggtaatgggcatgtgatcggttgccagggaaggagtagagatgtcctatacttgtgggttaagatggggggatatgagaggaagaggcaaaggaggctttgggttggggagaagggtggcaatgagatgtggctgtagtccaggaatagtcagggaagcagataatttggttaaaatatctcggcctaataagggaactgggcacttgggggtaactaaaaaagagtgcttaaaaaaatattgtctaagttggcaccagagttggggagttttaagaggtttagaagcctggctgtcaatacccacagcagttatggaggcaagggaaacaggcccttgaaaagaaggtaatgtggagtgggtagcctccatattgattaagaaggggacggacttaccttccactgtgagatttacctaaagctcagcgtccatgatggtctatggggattccgaggcgatcgggcagcatcagtcttcagtcgctaagccgagaagatctgggaaggagtcagagagccttgggccagagttccaggggctctgggagtggctgccaggtgagttgaacagtctgattttcagtggggtcccgcacagacgggacacagcttaggaggaatcctgggctacggcattccttggcctggtggccagatttctggcacttgtagcaagctcctgggggatgcaggcctggaggaatgcctggccactgcggtttgggcatttggaagttcttgtatgctggagatgtggctggggtttctctcagagtggaggcaaggaattgcaactcagaaatatgttgttacttggctgcctctactctattattgtacaccttgaaggtgaggttaattaagtcctgtggtggagtttgagggccggaatttaatttttggagttttatttaatgtcgggagcagattgggtaataaaatgtatattaagaataagacggccttttgaccttttagggtctaggctgtaaagcatctcagggttgctgccaaatgagccatgaactgggctggatttttatatttgatgaaaaagagcctaaacgctatctgatgtgggataaagaaaaaggagcattaaccttgactatggctttagctccagccacctttttaagagtaaattgctgggcaggagatcatgtatggttcttccaagattgccaaggtatcctccaactctcactggtggtttcggggctcaatgcaggaaatcatattgctgattttctagtccaacttgctgttctctagaagagagaaggggtaggaattcagtagccacacaatctggtaaaaacatatccatttaagcataactaatcctcccaaaccctgtgggcagggatgtttttctgtggctcaagagatgcccacacaaggattctcccaggatgttttaagttcaatgagcagagacataaatgccagatctcctagggtttggctaaatcaagcagacctacaagaggagtgtggggagtctggggataggatgaagaagcagaggccccagattggattggctgggactgaggaggcatagcatcctgctgtctgtctccccacaacctaagagtccataatttttgagaactggatgaagagggaaaggtgcttcttagatcttaccatcttcaagaagcatgcagacatttccgcagaagacattactgcattaatgatgaatttgagattctgagtgtaacttgcagaaggttctgcctatcagtgagaatctgtgtggcatttcagttttggctttgataaaattgaggagtatatgagcagtaacacccaggagggtgtttctcactattatcagcccctccaatgctccaggacccactccattgatttcccttcttcctctccccagcgcaaggatctgggtggttttctttgttgttgttgttgttgttgttgttggcttctggagtaaagttccagtccccaatcatcctcccttcaacaactcagctgctatgacgtcacctctatggaatttaaactcacagaacctgagttcaattcttagagcaactagttctgaggcactttctagtcccccattttacaggatgggaagaattgaatctcaaagtagggaaaaaactttccttccaccttcacctctccacttctggctgaaatggccctgaaagactcagctcttccctacccatattcatcatgcaatatctactcaccaccttaccttcaattcttctgaagatttcacttttgttatcccagtggctccaaacttctctccatcaagcatgcattttatttctcctttttatgcccaatgttttgaaatactcaatcctaataaaagggcatgtttcaagaaataattagtagtcctttcccaatttggtgttcctctttggaactcttaactgaggacataaactcctaagtttatgtcctcctcagtttatgagctaggaaccctccatgcaggctctgaacctggtggagctcttccttggtaagtgtcctcctagacaaaaactcagtgaggccaccactgtcccccaaacacagataaaaacattgcattacttgcagcatcaggagatcctcaagcctgagaattaaacatttagttttcttcagggattctgacttttttaaaaagctgtgtttttatgttgccagcccctggcacctctctgcaataggactgtaaaagtctttttgttttccacccactcttcattttgaagcccagccagaatacatacagtaatctgaaaattccattacaggaaaaaactctttctttccattctcctgacactggcagaaccacaatgccaaggagtatcagcaatttggacatctgagtaaagctggcaggagactcaggattttaccaggctctgctgggggtagaaaagggttccagatgaggagtttggagaatgtgtgactcgactctcactaccttatctggttctgcctcctccactcctctggccatcactccctgggtgggcactggcttctcacaaagtacttcctttttcttatagctcatacacctctcattgcagaaataaattctccacacttttttttaatttttgaaatttgaaaaatatacatttgaaaaacagaaaagaacaaagagaagtaatgagatagtagttattccttacctagagataataactgttgataatttactacgtgtccagatttttttactgtatcaatacatatatcatctgaatttatatctaatctttacctctactcatatataatctatatatatgtgtttttcatcaaatatgcctcagattatacatgctgtttctaacttttttcatttaatcaaatattgcagaaataatttattttctataaaatgattttgggagcaagtactgttttctttatgtatactgcacacaagtgcataaatcattagtggatttttactacatacatacccatctagacaccacccagattaagaaagagatcatcagataatattcctcttctctcatccaagaaaaggtcatcgctattttaaattttatcaccatcaattagacttgcctattttaaactttatataaatggaataatacagtgtgtattattttgtgtctggcttcttttgctcaacatcatgtttggaaagtccgtctatattgtggatgttgttcattcaatttcattgttatataatattccattgaatgaatataatatttaatccattccacttttgatagatatttggattgtatccaagttagagtcttatgaatgtttctatgaccacttttatatatggcactgggcatacatatagatattcctgttgggtatatacctagaagtggaatttttgggtcataggatatgcatatgttcagttttaggagatctgccaaacagttttccaaattggttatatcagtatacattctcatcagcagaatatgagacttccagtgatgctgatttttctgcaacatttaggtttcttaaaaactttttttttttttttagatggagtcttgctttgttgcccaggctggagtg[133 bp omitted]gacagggtttcaccgtgttagccaggatggtctcgatctcctgacctcgtggtgcacccgcctcggcctcccaaagtgctgggattacaggcatgagccaccgcgccctgccttaaaaaatctttttcattttagcccttctgttatgtgtgtgttttgtgatttgaatttgcattttcctgataactaatcaagttgggcacctttttattaccttttattgaacatttggatattgtcttttataaattggctggttgaatctttttgctcatttttcaattttatgcccttttcttatttattacacattcttatataccctggatatgagtcccttgataaatatgtatattacaaatatcttctctcactctgtaatttgctttttcactctcttttattttttaataaacagaaattattattttaatgtagttcaatttatccatcttttcccctatggttagtatttttgtttcccatttaagaaggatttcctgccccaaagttatgaagatattcttctgtgttatcttctagcatcttacgttatatttttgacatttaaatctatagtgtaacttacagatttaaatatatactttaatgtatgtttttacttcattcacttttttctttttattattttcttccttctaacttccactgtgatttttatttctttttttttgttctgccaatttttgcttaatatatttgatgccgtattactagataaatcacatttcaaactactatttgtttgtggtggattgacaatttcatcatcatgaaatgtccagttttatctttaataatgcttcttgctttaaaggctactttgtctgatattaacatattcatactcacagtcttttgttagcatttgcatagtatacttgcttacatccttcaactttcaaaccttaaggtagatctttcaaaccttatatttaagatagatgtcttaagctgcattcgttttgtttattcactctgacagtctttgtcttttatttgtaatattaggtctgtttgtatttaatgcaataaatgatatatttgggtttgtatcaaccaattactatgcaatttctattgtccaacagctgttctatttttctttttatccttcttgcactttggattaatcaagcttttttcctataatttcattaacactgcccccctcattgacttgttagttagttattctcttacattacaaaattcatcttggacttattagggtataaaataaaatttgcatcccaggcaatgcaaaaattttcaaacattttacctccaagtactcacatcttttgtgtttttttttaatgtaccataattctacataaatctaaattccatggaaattactattgactgtataatcaatagtaacttaaataaagatatctcggttttggccctgttgatgttttgggccatataattatttgttgtaaaaggctgttccacgcattacggatgtttagcagcatccttggtctctatccactagatgtcagtagcaccaacccccaagttgtgacaattaaaaatgtcttcaaacattgccaaatgtcccctagtgggcacaattgtcctgacttgggaaccacagattagatttacccacatattttccctttctgtttttcttcattccttcttccattttcttgttcatcatttgcctgcataaatctctgatatttcatttcttttcttttctttttttttttttttgagatagagtctcactcacccaggctggagagcagtggcgtgatcctggctcactgcaacctccatctcctgggttcaagcaattctcctgcctcatcctcccatgtagctgggactacaagcatgtgccaccacacctagctaatttttgtatttttagtagagacgaggtttcaccatgttggccaggctggtcttgaactcctgacctcaagtgatacaccctccttggcctcccaaagtgctgggattgcaggtgtgagccactgtgcctggcctgatatttctttccatgtgaaagtgctggtgatgaattttctcagtctttctctgaaaataccttagttctggtcttatttttgaaagatttttttcttaggtatagaattctaggttagcattattttccatcagcaagttgaagatatcattccattgtcttctccctttcattatttccattgggaagacagctatcagtattactgttattcttaaaaaggcatgtctttttttctgtcagattttaagatttttctctttgctttggcttcaagtaaaattaaaacagatatacctacatatggttttactgtgatgtgcctaggtgttcactggtctcaggcggcttctttaatatgtagcttgatgtcttatatcagtttaccaaattctcagccattttccctttctttgctctattctgtctttcttctccttctgcatctccaattacacatatgttagttctctcactatatgctatatgtcacattcattcttttctatactttctagtattattttcctctccctgttttagtctggatatgttctgctaacttatctttcagtttgatcaacctctcttcagctgggtccaggcttctctaaatagcatacactgattattttatttttatcattgtatttttatttttgggattttgattattttcttttttattataatgagtctcttgaatacagcacacaggtggattttgactctatctggcttgccactctgtgtccttaaattgggggcatttaacccatttacatttaaagttaatattgttatgtgtgaattgtatcctgatatcatgatgcctgttggttattttgcagacctgtttatgcatttgcttcatagtgtcactcatctgtgtgtttcagtgtgttttttgtagcggctggtattggtttttccttccatgtttagtgcttccttcagaagctcttggaaggcagacctggtggtgacaaattccctcagcatttgctgtctgaaaaagattttatttctccttcacttaggaagctcagctgggccaaatattaaattctaggttggaaattatttgctttaagggtgtttaaaattggcccccgatctcttctggcttgtagggtttctgctgagatgtctgctgttagtctgatgggcttccctttacaggtaacctggtccttctctctggctgcccttaacattttttttttcattttgaccttgtagaatctgatgattatgtgtcagggctgatcttctcatggagtattttactggggttctctggatttcctgagtttgaatgttggcctgtcttgctaggttgggtgagttttcctggatgatacactgaagtgtattttcctacttggtttcattctcccagtctctttcaggtaccccatcatttctaggttcagtcttttaacatagtcccatagttcttggaggttttgttcattccttttcattctttttttctctaatcttgtctgcctgccttatttcagcaagatagtcttcaagctctgatatcctttcttccacttggtctattcagctattgatacttgtgtttgcattatgaagttctcatgttgtgtttttcagctccatcagatcatttatgttcctctctaaagtggtgattctgattaacagcacctgtgatgttttatcatagttcttagcttctttgctgtgagttagaacataatcctttagcttggtgaagttctttattacccatcttcctaagcctacttctgtcaattcatccatctcagtctcagcccatttctgtgcccttgctagagaggtgttgcaactctctgaaggagaagaggcactctggctttttgagttttcagcattttttctcatcttcatgggtttatctacctttgatctttgaggctgctgacatttgaatggagttttttatggtgcctttttcattgatgctgttgcattctgtttgcttttattttagcagtcaggctcctcttctgcagggctgctgcagtttgcttgtggtccactccagttcctatttgcctgggtccctcccatccctggagttatcaccagtggaggctgcagaccagcaaagatgccaagctgctccttcctctgagagctctgtcttagaggggcactggcctgacgccagctgaaacactcctgcatgaggtgtgtggagactcctgttgagaggtctcacttagtcagcaggagcagggtcagagacctgcttaaataagcagagtttctgccccttgaagggtgtgccacactgggggaatcaccctcatctgggctgccctgactctccagagccagtaggcagaaaagacagatcattgatccacaataccacagctgtccctcctcctaggaggtcctctcagggttatcagtgccccatccataaacccctggctggggatactgagattcccactgggaggccccaaccagcactttgggaggccaaggcaggcagatcacttgaggtgaggagttgaagaccaacctggctaacatggcgaaac[131 bp omitted]gccactgcactccagcctggacgacagagtgagactccgtctcaaaaataaataaattaaccctaatgaataaagctttaattgtggggcattcagataatggaaaattgtccttagttaggggggacttctgaaagcccttctcattttgtccctgttgacacaagcaacattgcctttgcttggcatgaaacccagcagcagggcctaggcacagagatcagctccctaactattctgttgatgcaacagcatcactggatgtctcatatctgagatactgctgatctgttctcctcttggtttgggcacaaaccatgcagatgggacattagtgatgttccgatgatgcagtgtcccaggtagcaaaagcaataaggcagaggttgatccgagtgagggtaggaatagggcatggagtgatgctctggattcttggcctctgcacttagcacaaaggaggagtgtctggagcagactgacaaggaacaaaatagttccaggagacaggtgccatgctgctgcttatttgggttgaaacacaccagcctagattagtgtttctttgaacaactattaataatatttgttgcttggaacaatagttgttagttgtaactaataaatctattgcttacccctgctatacccatgggatacaccccaccccaccttcatctatccattacaaaaaaactcctgtgttcccacagaagtcaaaacagatatttccccccctggggaatgctcctgataaaatccacagtactgcagatggagggctcctagacttaaaaagactcttcagggcactatgtgaaaatagaagagatcctctgacttgagacagagcaagaacctatggggaaattctagactccagaaaagaatccagaccttttatatccattataagagggagcaaaaggaaaaaagaaagtacagaaattccaaattgaacaccaagttcacagtccagtgtgatgtcagaactggggaccaggcagagcacatgatgtcaaagtaggaaaacaggatttcattccttctcttcttccctctctgtcagggtccagagagagcctgggctgggtctattttctccaggataaaaatatatatacactcaaaagtgtcccaattccttctttttttttttttttttttttttttgagacggagtctcgtgctgccacccaggctggagtgcagtgtc[131 bp omitted]tttcaccatattggtcaggctggtctcgaactcctggcctcaggtggtctgcccgcctcagcctcctacagtgctgggattacagatgtgagccaccgtgtccagccccaatcctttcctgtttctcaaggccatgtttacatttagcatgccccagggaccctactctgaacctctcaccatcaacttcctctctaccctctccccttaactcataggtactgactgtgagtccccttatgctttgttatcatgctctactctggactctacttgtctatattataaaacttataatgctgaaaggcatgtagctaccttatccatctgtgcatgaatacctagtcccttttcctatagagaggtatcaacccaggcacacagtagcaattttataacctcctgttgattacttaatggaagttattaaattttaaaatgagcctattacaggttatgtggatcctgaaagagtaaatgaccactagtggaaatgaaatcaactaggcaaaaaggacaaatctaatacttcttaaaccgaggaataggtaatagtacctttgagtactgctactttgaaggctatccttccatgaaggaaattaaggacaactagaggaaacagaggaatggtcttaagaaaggaaaaaagagggtaaggataaatggagaagcaagttgagggcacctgtggatcagttatggggatatgcccatatacgggtggttgcttcctacagatattgggtacatgtagaagggagaggtctttggggacctggtcgagaaaaagtggctatgtgatgagtggcagggatgggaagtcagtgaagaagtcaaagctcttggacagaaagaagagtcaggtacgtggctttaatgagggaagctaagggtgctggagatggagtagtagaagcagaaatcctaggtctgcttgattggaatatcaaggctgggatattctctcccatggaagtgggtccaggtgaagcaaggaggtaaccctgtctccctctcttcctttcccatctcccactgatggatcacaaggccaggtaaccttggccatttacttgtcagtccaggcacatctctctctggtcaatgtagaaatccatatatgaatccatttggaagtgcctgaataataatccacctgttgggattgtgtcagggcaggtaggtatgtacaacaggctgaggaaccttgagaatctacccttttcaaacttaacaacccttctagactccagaatccatggatttaactgcttcttaagaaagcgtcctctttgtactctccaagtcctgtgtttgcttaaactcactccctttgcctgatctgctcctgcagtctcccacaggatccacaatgtgctggcctctagagcttccctatttccccttggccaaaatgaaatctacttttatcatcccaaactctaatgaagtcatccagtgaaatccatactcatagaactcgagatcccaaaagagcctgagagttcctctagactctcacccatatcttatctctccctgactcttattctctctctactgtcaatcactcactccagtcgtcttctagagtccttctttaaccttctttccaacctcttgacctttccactattactagtgtcatagctcataagtatccagacttcaccatcttctcccttttcttcagcacaaagtgaatgcattaagaaataagtaatttttttttctcccttggaagtgatcaaagctacatacaactggttctcgaattcttttttttttatacagagtcttgctctgtcgcccaggctggagtgcaatggctcgatcttgactcactgtaacctctacctcctgggctcaagcaattctcctgtctcagcctcccaagtagctgggattacaggcgtgcaccaccatgcctggctaatttttgtatttttagtagagatggtatttcaccatgttggccaggctggtcttgaactcctgatctcaagtgatttgcccgcttgtggttctcaaactcttgacacatcagttgagtggcagtgtccaccgtgccaaagccttcccaacttcagatgacctgacgttttctttcgttttgcgggggaaatgtaagtaaaagttcctggaaatttctcagttaattcttacaggtctggaaggtggtctgtaaggaagtctttggatgaagcttgaaaagggtgcaatactcatcaaagcagtgagttcagcaccaggcagattgaatgtaccaccttctctcccctcttcaggtcctatccttaccacccatgtggtctcagggcttgggtcatctagtatgaatcacagcaaaccaggggtcatagaagttagaggtttatgatattaagtatatgtgcatcttagtgatgggtgcctcttggaatagtgaggaagaagggaggaaaaatggagaaggctgtgccacacatagaccaaaacaagaaggccctctctttgaggggccctcctctagctctgtcatttccccatagagcaaaaagcttatggaaccaagaggatgctcacctggagactgcactgccgcttctagattaccatgggtagcaagtacccaagaacaccctttccaaatggctctaagcccatctccagacctgtgcaggcttttcctaagatatatcttccaaaaaatggaccttgtcattggtgtgcatatacctgaacccaagcattggccaaggggcaacggtttgcaggtacatgtggagaaagcttagaattgtgggcttttgtgtctactagactgagctttctacccattcctccatatactcctcattattttctttttatgattacaaaagcaatccatatttattgtagaaaatttttcaaaaactgaaaaacaataagaagcaaatagaaaattaccagcaatttaatgaccctgaaattatcatgttatcattttggtgtatatgctccatgtagtgcatctccatggggtgtgtgtgtctctgtgtgtgtctgtgtgtgtgtctgtgtatctgtgtatgtgtgtgtgacctacacacaactaggcattccctagtggtgccaaacaatcaatatcttttatgggccctccgttaaacatcgctgtactcacaaagaaacataaatccaattctataaatattgggaattttactgatggtaaaattaaaataggaggaggaggttacatcactatcatatggtaacattcccttaaaaatcatctctttatctttcctaaatattccactgtctttgactgctatacctctctctcttttctttcaccaagcctctctctttgctttccttctggtaaaagcagtctctctctctctctctctctctctctctctatccccccctctccctctctctctacccctgaatctggcctttctaaacaccctcaacttgtgtacctgtatactatactgagctacactaaagtttctatatttagccaaatccagcccatcataccagctcttcccctggtatattcctaggagtggagctcggttcacgctgtttcacactttccttgggaaacactctgtgttcttctgcaaagaggagtaggcaatatgttttcagattcacagacaagcttctccttccaccgtcttgctcccaccctatgctaacctgttcacaaaggttaagcaagcagttggaattatggaatctcccatctggtttcctaatcatatttttaccatcagtatcaggcccatactcatgtttcatccccacactgctcctagccaggttcagaacctctctctagggtctcctcctctggtaacaaaagaatgggtttaccatgtttgtttctcattagcataagtggttataagatgcacctcatttgctataattgaagaaaagacaagtgtatttccactctcagagtccaaggcagtcccaagtgtgacttttaatatgtctcacactttctgggctctgagaagggcaggatgctagtgctcaaatgaccacaacaatgacaattataaacatctctgacatgagacatgatgtatacaactgattgtacctgtgtcctgggtttatttgcaatgcctgcaaatgaattcaccctgtagggagattattaaaactaccatggatatgtttgaactgttgtgagaattaccaaaatgtgaaacagagacatgaagtgaggacatgctgttggcaaaatggcacgggtagacttgttcaatgcaggttgccacaaaccttcaatttgtaaaaaatgcaatatctgcgaagcataataaaacaaggtgcaataaacgaggtatgcctgtatatccgactgattgatggtgctgttgagttcaactgtgtccttactaattttctgcctgctggatcccattcataactgaggcatgttgaagtctccaactacagtaatggattcatctatttctccttgcagttccatcagtttctgcctcacatatagtttttaaatgtatttttaaatgcacatttgactttttaaaatgtatatatttaaatgtatatattttaaatatatatatttaaggtacacaatttgatgatttaatatacatatacactgtggaataatcaccacaataatttgtctatcatctcagatagttaccattttctttctcccctttattcctttcttgctttttttcctttttttttggtgagaatgcttaagatacattatcttaccaaagttcaactatacaataaagtattgttaattatagtcacattgctattcatcagatctcaaaaaaatattgattatgcacaactaaaacttcgtacccctttgacaacttctccccacttcttcctccctccagctcctggttatcaccactctactatctgtttcaacgggtttgactatattagatcccacaaataagtgagatcatgcggcatttgtctttctgcatctggtttgttttacttagcacaatgtcctccaggttcattcttgttgtgtcacctgatagagctgttatttctatcttggtgaaagctgaataatagtctagtgtgtatgtatgtgggtgtgtgtttaccatattttttaaaatccatgcatccatcaatggacatttagtttgcttccacatcttggcgtttctgcataatgcttaaatgaacatgggcatgcaaatatctcttcaagatcctgttttcaattctcatcgatatatatcaagaagtaggactgctgaatcacatggtagttctatgtttaattttgtttggaacctctatgctgttttccagagccactacaccattttcattcccaccaacagtgcacaaggttcccatttccccatgtccttgccaacacttgttatcttctgttttgtttttgttttatgggaggtgtgtgtgtgtgtgtgtgtgtgtgtgtgtgtgtgtgtgtgtgtgaaatagtggtagtcctaatgtatgagatgatatctcatggtggttgtgattagcattttcctgatgattaataattttaagcatttttccaaataaatggccatttgtgtatcttctttggagaaatgtctgtttaatcctttgctcatttttaaaatttgattatttattattcagggggctgttattgagttaaaggagttttaaaatatattctagatattaacctcttatctaatatctctcttgcaaatattttctccaatttcataagttttttagtttgacgtcaccctatttctctatttctgcttttgttgcctgtgctttggtatcatatctaaaaagccatttcccttttcaatgtcatgattttttaattgctttcttctgggagttttatagatgtttataaaaaattaacttctttttgagttaatttttgtgtatggtataagggtccatactaacaacatttattgaagaaactaccctttccccaatgtacagttttgaaactcttattaaagatcattagaccttgtatatgagggcttatttctggactctatattctgttctatcagtctacgtatctgtttttatgtcagtgttatactgttttgattactgtgactttggaaatatgttttgaaatcaagaagtgtgatgcctctagctttattcttctttctcaagattgttttggctatttggagtcttttaagatttcacatgaactttagaatttttttcctatttctacaataaatgccatttggattttgatagggtttgcattaagttcgtacattatttcgggtagtgtaaatatttttaacaatattaagtctaccaatccttgaacacaagatatctttccaattgtttttctctcttaattttgttcagcaatgttttgtagttttcagtgtacaagtcattggttaagtttattcctaactattgtaaatgcgattttaaaaaaaatctatttggattgtccattgttactatataaatgcaactgacttttgagtgtttattttgttctattctgcaactttactgaatttgctagtctaataatttttgatggagtctttttatatacagttttctacatataagaccatgtcatctgcagagataattttactacttcttcttttccaattcagatgcattctatttattttccttgtctaattgctctggataagacttccagtactatgtagaataaaagtgctgagtttggacatccttgccttattgctgatcttagaaaaaaaaactttcagtttttcactatggcatatgatattagttatggcttttcatgtatgaaatttatgatgttgaggaaattctttctattcttattaatatattgttgaatgtttttatcatggaaaggttatttaattttgtcaaatacttttcctatgtctattatgatagtcatgatttttttcttcattctattaatatggtgtattacatttattgacttgtgtgtattgaactatctttgcaacccagtgataaatcccacttggttgtggcatataatccttttaatgtgctgttaaaatcggtttactagtattttggtaaggacttttgcatcaatactcaccagggatatgggttgtagtcttcttttcttgtagtatctttgtctggcattggtatcagggtaatgctggcctcatataatgaatttggaagttttctctgattctgtttttttggaagaagttgagaaggattcatattccctattctttaaatgtttggtaggattattcagtaaaaccatctggttctgggtttttctttgttgagaatttttttctttgttgggagattgtatgtttctaagaatttattcatttcttctaggttagccaatttaaataaaaatttctgtggcaccagttgtaatgtctcctctttcatttctcacttatttgaatgttctctacttttttcttttttaggctggccaaggatttgtccattttgtttatcttttcaaaaatccaattcttagttttattgacttcatgtttactatttttctattctctattttgtttatgtctgttctgattttatcatttttgctaactgtgggcttagtttttcttctttttctagttctttgaggtataaagttaggttattgatttgagctctttgtacttttttttttttttgggacagagtcttggtctgtcacccagactggggtgcagtggcgtgatctcagctcactgcaagctccgcctcccaggttcacaccattctcctgcctcagcctcctgagtagctaggactacaggcacctgccaccacgcccagctaactttttgtatttttagtagagacagggtttcgccatgttagccaggatggtctcgatctcctgacctcgtgatccacccacctcggcctcccaaagtgctgggattacaggcatgagccaccgcgcccggcctctttgtacttttttaaatgtagatgtttattactatgaatttccctcttggtactgcttttgctgtattccataagttttggtatgctgtgttttccttttcatttgtcttaaggtatattctaattgtatttattattcctccttgaagcaatggttgttcaagagaatgttatttaattttcacatctttaaaagttttctagttttgtttctgctgttggtttctagtttcattctactgtggtctgaaaagacacttgacataatttaaatcttcttaaatttgtcaaaatttgttttctaatctaacacgtaatcaatcttggagaaagatctgtttgctcttgagaagaatatgtattctgctgttgttgggtagaatgttctgtatatgtctgttaggtccatctggtaaacagtgttgctccagttagctctttctttattgattacctgtctggaaatcctattcatcattgaaagtgagcattgaagtggcctattacaggattgctatcaatttctcctttgaaatctgtcaatatctgctttatatatttatatatttatatttaagctgatgttgagtgcacatgtcttaacaattgtttattcctgttgaattgacccttttatcattatataatgacttcctttgtctctagggatagttttttattaaagtctattttgtctgatataagtatatccacccttactttcatttgattatcatttacatgaaatatatttttccgtccctttacttctagccaatttgaagtgagtctattttagacagcatattgatggatcttttttagataattgttcagccactctgtttttggttggagaatttaatgcatttacattcaagttaattactgaaaggtgagaacttattctgcctgtgttgtggttgttttattcttttccctctctttctgtcttccattgttatttgatgatttcctgtagtgatttgctttgactcatttctctttatcttttatatctattgtaggatatttcctttgtggttagctcccagcttgtgtaaaatatcttgtagttataaccacctattttaagttggtaacttcaactgcaaacgaaaactttactttgacttctcccataaccacccactttgagtacctgtagtcagggtttgcttctttttatattgtgtgtttattaacaaatttttatcttttactttcatattaaggttcaaagtaattcatgcatcaccttcacagttttacattattctgtatttatatatttacctttctcaataaggtttatgcttccttatgcttttgcattgctattcagtgctttttcatttaatttgtttttgtttgtttgtttgttttctgagacaaagtcttgctctgtcgcccaggctggactgcagtggtgcgatctcagctcactgcaaactctgtttcctgggttcaagtgattcttttgcctcagcctccagagtagctgagattacaggcacccaccatcatacccagctaacttttgtgttttttttagtagagatgaggtttcaccatgttggccaggctggtctcaaactcctaacctcaagtaatcctcccacctcagcctcccaaagtgctgggactgtaggtgtgagccactgtgcccaacctttcatttcaatttcaagaaccctctaaagatttcttataaggcaggctagtggtgacaaactcccccagtttttgtctaggaaatgttttatcagtactttatttttaaaggataattttgctaggtatagtaatcttagttggcaagttttttctcacactactttgattatgttgtcttactccctcctggcctgcaagttatctgctgagaaatccactgataattgtatgggggttcccttatatgtgatgagttgcttttctcttgctgctttcagaattccttccttaacctaggcttttaacaatttgattaaatgtatttcattggacagggtgatatggaggccagggtcttgggtctgtgttgaggagtctggctttgcatgagtagacaggtcacagattgccaagtacttgccaaatcccattttctgttcttcttgagaaaacagctagattacatttcccaatctcctttgcaaatatgtgggaccatatgactgtattatggtcaatggaatgtggattaaaataataaactttgcttctaggcctagccctttaaaagcttctgtgtgagcccccatgatacctttctttccctattgctggttgaatgtagaggaaccagtagagaagcccctgcgagatgacagagctacagatttaaggagctacattccttgaatcatggcagggatgactgcccactgaccaccctcagtgaaatgcattgtgaatgagaataacctttcatgggttaactgtattaccccatgaggtttgtaaaaatctgcttgaatatttgctccagcaattaaccaaactggttcatacatgggtctaactgggaaggcagaactgggcacctctgcccatgattgagtggaaacaactgttgggactgctgaggattgcaatgagagaaattaagtcatagggaggaagttaaaaaaaaatatgcagagccctcaggttgatgtagcagtttatttgacaaaagcttcagggtaaagaggtcaaggaaatagcagaaaggttaccagctagagccagtgggtgtcccaagaaggaagtaggcagcactcttcttagaccagatggtcatccttcagcccacagtagtgatcggccaatagaatctaggggtttagcattgatttaaggggctctctagaagagaaaagttagtcaaaagtcaagaatcctgggataaatccatttctaaaattaatagcatcctaggccccagatgaaaaaggacagcaattcttctgctaaatcagaagttacccacttttaagcaatttcccccaagaagtttgccaactgaacagacagatagataccaggtctccttgggcctggctgagagtagagcgcccatggagacgcccaactaaggggttagtaattggaactttggataaaggagggatgtatgaactgttgggtgatatgttgagggaagcaaagggaactgaataagagtgaagaaaaaagtagaggacctcatgttggtgtcttggtttattttgcagtgaggagcagcctaggtttggagataggaggacattgtcttttgctgcctatttctttaaccaggatttgggtggctgcggtcttttgaatagtcggtaaggaccagtgatgaagcatgcccaggccctagccttcccaccccaaccaactcactcgttgtctaagcagatgtttccacagtaggtccagcagcatgtatgatttggacgtacacaagtcattattttagtacaccttttctcacagtacttatatggaggctgtacccagcactgctcagtttctcttatcatatctagaactgagatggaagaagttagcagggtccgtctattcacaactcagacaagaaaccttttctaagcttaacaatcccttctgaaacttgagctccaagccacaaagtatttctctgccttccaagaaaatcccttcctcaaattataaccagtgtcttgtcacaagaccatccttgcatggcctgtgttcctccatctacatgtccctacagcatttcagactctaaagataggacctgggacaccctgaccatatatgacaccaaccaccaaatttattctcatgtaaccttagatttcagggcctgcaatatcctctaactccaatttccaaagccaatttgcagagtgggaaactgagccaagggagaatagaaacttactttttttccccttctcttttttttttttttgagacagagtcttgccctgtcgcccaggctggagtgcaacggcatgatctcagctcactgcaacctccacttcccgggttcaagcgattctcctgcctcagcctcctgagtagctgggattacaggagcacaccaccatgcctggctaattttttgtatcttaatagagacggggtttcaccatgttggttgggcagtctcgaacccctgacctcgtgatccgcccacctcagcctcccaaagtgctgggattacaggtgtgagacgccgtgcccagccatttttctccccttctatttgtttccctgatgatgccacctaagaagtcagtctctccataaattttatttccctggcccacaaccctcctgctcagtgtctttgttgtccacattttcttatcatatgaacccaaactttgacccactaaggagcctttatttgtcttttccatttttcatgttctaaaagactcttcccctccaactaaattaacgtgttaaatattacccttttggcattcatcaaaggctcacccaactgaggcacaaaggttctgaaaatatgggcttggagggaagctctgtgttggtttttcctctactggtctgatattggaaaatattatttcctgctagctgatggaatatagacaaaagatacgttcccttttcacatacctagtgttgctttcagagctgaaagagaaaacttaaaggaattgggaatatctaacctaatcttgcttgaatatctctacttaaggagagatcctttaaagcctgattcttgacatgcaggccctggatcagctacaatagacatcccaggactgggcagagcaccccgtcccttttcacaccacccacagggatctttgttccagaagcttcccagcacaggcagaagcatcacaactccagagatgaacatgacgagtagaagaatccagggcttcatggtgctctctgtgtgtatttgggttaagttctggcagaaggcaagtcttttcccaatactgctagacgtagaaaatggattgaggagaacagggtaagcaacaggggtaaagtgcttatgactatcatgttattctttccctttctagtacccagtagcataccaaccaactcccaggctagccagtgacttccccaggtttcttctcatctcatattacataccccttcctttgcaaaattatttcttattaaaatgaatttctcctgtctgattaaaaacaataaatcctcagattatataatatgtaaaattaaaaatacaaagaggaaataaacaagcattagcaattccaccatctagagataatcaatatatgtctatacttttatgttgtagtcattatttttatgaaattggacacatcaagtgtcctgatattttattttgaagcatatgaaacatgatgatgtaaagaagttttagtgaagatcctaagacaaaaggcactaaagcaatttaagagggaattacagatagataacaggacttgagaaaagatgatggccaagaactgttaggggactcaaaactttaatgcactaagatggtccaaagttggaggaattgtagagaagattttgaaggaaattttattggtaaaaagctttgctcgtgaaagccggaatgctgcctcctaattccaagttgagagaaaaggttttatgaatacgactcattgagcttgctatgtgatcctagaagtctatgggaacacagtagacttgaatcatgactgaagactttaaagggtgactttaaatctggccaaagcggcctgtagtagcagagaagagggctctaatttgtgaagtatctgaactgcaaatggccagacgacatttcatgtttccaatgaacccttgaaatctcccacgaaagagtcaagaccagaagcacagaaccagctcatgatagtatctattacacaagaactttcctactactcttattggtccgtcctccctctactccctaggagacagaaacttgctttagtccagagtgggtggaggaatagaattacaaagagccagagtgggggtggtgggaggcgggggagagagattcaccacatcctgttccataactggagcttctgagggagggaggaatccatagttctgaacaatttatgtagttgtgactaatttcatgggcctgcacattttacttattatattgagaagatgtttcatgactggagaatcacataaaatttgtggagacctacctaaattttcctgaagaagcaaggaaataaactaacaattctgaatgaaatatacaggggaggcaaaaatatgctcacatcatacaagtcatgacaagaattcagtcatacttattactatcatttcctcatatcatcaagacctgaatagtttcaatttcttctcgttataaaaatgtcctgatgaacctccttatagttaaagctttggtacatatattgttatttttatagcatgagttaatgaagaaagatttctaggcaaaagacattgtctttcccaggctttggataattgccgccacatttctctcactaagggttaggttacatttccacctaccggatatcaaatgcatgtccctccaccccttgttctactctaggctatacaaaggtaattttcatcaccacactatttgctgatgggtattttaagaggaaagaacatgggccccagagtcagataggcttgaattagaatcccaaccccaccaactcctagccgtggagcctgggccagccacataatccccagagcctggttttccccatccatattacagaaaaaaatatcaatactcatctcatctcatagggtcactgggaagattaaataatatgtatgaaacactaagcataggacctggaatatagtatatacttcataaatgttaactgtcagcattaagctcagaatatcctcctctggatatttgaaaactattttcaattacaatttttttctttttacttttttttttacacttagcattttaatctgtttagattctatgcctctgtgtgtggagggagacagggggagttcattcactcaataagtacttattaagtgcctaactatattccaagttctgggtattggaatatattccaagttctgggtattggaatatagtggtgaacaaaacagacaaaaatcctcccatttatacagctggcattctagttaaacaagataaggaaatgcatagatggtaatcagtggtaaggagaaaaataaggaaatggaagaaaataaaatagccttcagctgagtgacagctgaggggtaagggaaactagagtatgggaacagcagaaaaatcttaataaaaaggaatagatagacattttcttaacactgtaaaaatttaactattgcaatccaaaatccagcattccacattataaaactgaaagtactcccattaaaattagaaataggaaaaaaagatatgcactattaagactactttttaacattattttcaagtgtttaagccactataattagaaaagagaaaaatttgaactataaataatagaagagtggaagaggaacctaattacaatggaaacttcccagccttctcccatctacccccctcattctctattgctctacttttctagaaccaaataggaaggaaaataagagtcaaagaaaaggataaaattctgacatgaattgcatcattgcatgaacaaggcagtgattttccctctgcctgaaagtctttatatttgttcagaaattttcaatgaagcaaaagagatttctttgtgctgtccaatgtggtagccactagccacttatgactgttcaaactcattaaattaaatcaaaattcagtttccagtcatttcaagtattcaatggtcacatgtagttagtggctattgtccccaaagtctttctctgatgcttctcattccatttatacataggacgatgggaatagtctacatcaacctttgacttcttgtgtgtcctatttaacattccttatttctcaggcgcggagcctttccatcatcacagaaagttctactgaacaatgctgctctagatgaatccaccaaaatgactctgctcaaaagcagaggtaatactagaaaaattttaaagctgccaaatttttcagaggagactttgaaaatgtattctcctcttagcttctgtgaaatttggaaggtgaaaaatacaagttttaggcacatgtcattagatgtattgacttttagacaaatcacttttaagagattcgagcagaggcaaaagcagcaacatcttagcttggcaacttcatcaagtcatgcttaggtaagctggcagagacacaggttcttaatggagaagcttggagagcaggaataagcatctaagagtagaacccccacacacacaaatatctgatctgatctacaatttaagggcttctcttctcctttcgtttctctccctaatctcctgctcttgctagctagcaatggcaagatactcattccttgagcctgagtccttgagaacctcagagtgttcttctgattatgtgaatataccagcacatggcaagacaggtgaaccatgaagatactctgttatctgcttacagccagggatgtgagggatgaggtaagtgggtgaaagtgggcatagattgcagtaggcctctggattcctggtaccaaccctttgcataaagaaggaggaatactgatatacagtgacaggaacaccataaatccaaagcattggattccatgaggctgtttctttgtattccaaaataccaccctagacccaagttttccagagctttgaaatctgttcattcacacggcctcattcttactctagttttctttctttctttctttccccttgccctttaaaggtgttcaggaatctgaggatgcctagtctcctgttttgcacaccctcaagtgtactaaatgatcccagacaaaagaaacatcattatgcccaggctgggtacttctcaacttctcatatacagagtgctgtgaattttttggtcatcctgagacaaactgcaggacaattcaaagatcccccaggatcagaaagacacagaactactgctctccaccaatctggctttccagataatgttaaagaggacagagtgctggatttagtgtcaggaatgctgaaatctttagtttctgtcccttttacctatggaacctcagacagctcatgtcaccccctctcaattttcttatttgaacaaaagaaacaataatccctacctcacaggaatagtgacaccatctgggctaggaattaatccaagcaagccacaaatagaagctcatgtctcaagacctttatccccacctacctctgaaggtgtctgcattgagtgtctgtagtaactggctgacagctcttttgtctggccttttattatgaagttgtttgaagtggggctcgaactgggggcagaagagcagaaaaacaatgttcaaaggccaggaacttaatggtgattttggttgtgaccgatttttaatttctacccagaaactacatgttggctgtatcacagattctttcctttgatattcacccatccagatgtactcaattttctaaggtgcaggtgggatcctctgaaaagctgggaagaacattgtgtacctggattgcagctcaggccacccccagcagacccaaagtacatgttcccaaagtctctcaaatacatctcagtccattcatatgtaggaagttgggaacagtctacattgacctttgacctcttgtctgtcctatttaacattctatctttctcagtattgattctcttttaccaataaaatcataacaagatctcccaccaaatgccctctgacttttatgtagctaaaaagagactgaataggaagaattttagaaaaagtagatgaccacctaacaaatgaaggaagcgacgtgaccaaatccagcaccaagttcttgccatgagcttgttggttgaggtgcagagggatttgttcaccaaatgtcagggaagggcattatattgggcacacaatacacatgatttggagatcactagctcatgagaaaagagaacagtcaagtgggcaggaggcagggacttccaaggggtaaaccttctctcaaagcctgtctgcaggaatattatacgcagtgacaggagatgtcaatataaaattcttcctaggatacaggcatacctcggagatattgcaggttcagtttcaggctaccataaaaaaggtaatattgcaataaagtgagccaagtgcacttttttggtttcccagtgcatatgaaaagtatgttttcctgaagtcttttatttatatatttatttaaactagaaaatgaaatatttaatagttgaaagttgtttctctgaaaaagctagtaaaatttgcaaacttctgatacaaatctgtatatgtttcagtatacaactgtacctctttcatattctaaacagtttctaatagttttcttatgatgaatttcattattacttattaaaatattaaaaaggtatgtttacactatgctgtagtctgtcaagtgttcaatagcattatgtataaaaaataatgtgcataccataattttaaaatactttactactaaaaattgctaatgattatctgagccttcaacaagtcatcatctttttgctggtggagggtcttccctcaatgttgatggttgttgactgatcagggtggtggttgctgagggttggggtagctgtggcaatttattaaaataagaacaatgatgtttgccacatcaattgattgatcctttcaagaaagatttctccatagcatgcaacgctgcttgatagcattttatacacaatagaatttctttcaaaatttcggtcaatcctctcaaactgtgctgctggtttatctaagtttatgcaatattctgaatcctttgtcatcattccaacaatgttcacagcatcttcaccaggagcagattccattcaaagaaaccactttctttgctcatctataagaagcaactcctcatccactcaagttttctcatgagattgcagcaattcagtcagatcttcaggctgcacttctaattctcactgttgctattttcatcacatttgcagtgacttcctccactgaagtcttgaaaccctcagtcatttataaggattggaatcaacttcttccagactcctgttaatactgccatgttgacctccttccatgaatcatggtatgtagaatagtgaatcctttccaggaattttttaatttactttgcccagatccatcagggaaattactatctatggtagctatagccttccaaaatgtatgttttaaataattttgacttgaaagtcaaaattatctcttggtccatgggctgaagaatgaatgttgttagcaggcatgaaaacattgatctcttcatatagctccatcagagctcttgagtgaccaaaatctttttttctgagccgtaggcctcaacagtgggcttaaaatattcagtataccatgctgtcacacagtctttgctgtttcatttatagagcagagcaagagcagagttagcatagtttgtaagggctctaagatttttgaaatgataaatgagctttggctcattattactttaagtcaccagctgcattggcccctagcaagaaagtcagtctgtcttttgaagttttgaagccaggcattgacttctatctatgaaagttctagatggcatcttcttccaatataaggctgttgtgtcttcattgaaaatctgatgtctattgtagccaccttcatcaattacagttgacccttgaacaaaatgggagttaggggtactgaactcctgcacagttaaaaatctatgtataggccaagtgcagtggctcacgcctgtaatcccagcactttgggaggccaaagcaggcagatcacaaggtcagaatttcgagaccagcctggccaatatggtgaaaccccatctctactaaaaatacaaaaattagcctggcatggtggcaggcaccagtaggcccagctactcagaaggctgaggcaggagaatcacttggacccaggtggcagaggttgcagtgagcacagattgtgccactgcactctagcctgggtgacagagcgagactccatctcaaaaaaaatttaaaaagaaaatccatgtataacttttgacttctcaaaaacccaactactaatagcccactgttttatttttaattttagagacagggtcttgctatgttccctaggcttgtctcaaactccccgctccaagcgatcctccttcctcatcctcccgagtagctaggactacagacacacaccaccatgcctgaaatattctttttattgagatggggtctcactatgttccccaggctggtctcaaactactggctcaaacaatcttcccccactcaacctcctgagtagctgaaagtataggtgtgcaccatcatgcctgactaatagcctactgttgaccagaagccttactaataacataaacatttgattaacacatattttgtatgctatatgtattttgtgtaccatttactcttaccagaaagtaagctagagaaaaaatgttattaagaaaatcataaggaagaaaaacatatttactatttattaaatggaagtggatcatcataaagttccttgaggatgtataatgaacccgcacagttcaaatctgtgttgttaaagggccaacagtatcttagctagatcttctggataacttgctgtgtagcttctccatcagcacttgctacttcacattgcccttttgtgttttagagagggcttctttccttaaccctcatgaaccaacctctgctagcttcaaacttttctgctgcagcttcctcacctctctcagccttcataaaattgaagagttggggtctttctctggatgaggttttggcttaagggaatgttgtggctggtttgatcttctgtctagatcactaaaaccttctccatatcagcaatagagctgttttgctttcttatcgttcctgtgttcccggagtagaacttttaatttccatcaataacttttcctttgcattcacaacttggctgtttggtacaagaggcctagctttcagcctatctcagctgttaacatgccttcctcactaagattaattatttttctagttttttatttaaagtgagaaatgtgggactcttcctttcacttgaacatttagagtctgttgcggggttattaattggcccaatttcaatattgttgtgtctcagggaataaaggggctgagaagagggagcaagactggcaaatgaccagtcagagcacacacacatttattgttcgccatgtcctatgggcacagctggtggcactccaaagcaattacaatagtaacaacaaaaatcattgatcatagatcaccttacagatataatgataagaataataataataaagtttgaaacattttgagaattactaaaatgtgacacaaagacataagtgagaacatgctgttggaaaaatagtgccaaaagatttgctcaatgcagggttgctgcaaaccttcaatttgtaaaacatgcaacatccataaagcaaaaattaattaataaagcaaagtgtaataaaatgagatatgcctgtatgttgagtgcactgaggggcaggaagtatatgtctggactccagggacttggctgaggaaggtggaccagtacagatacaaagagctttggaaccaaggtaaaaaggtgtgggaacaaactgaaggaaattttgacagggactgaaaatggtgccaaacctagagtgattgaattatggatttctaagatatttatttatatggcagcaaaatgatgttccatgcatgacgatcatagtcttttgctctgtgtggcccagctgctggagagctgaggagcacagtcactaatgagtagcccaggagtgccaaggactcctgccactcatgattctggatcaagctatgcagaatttaggacaatctgtatactcttctattttagttaagaatttcccagtgcagtatctgaaatactgtatccaataattctatatctagcaaagctatcctttcctgatgaaggtaaaataaagacattcccagaaaaacaaagactgagagaatttgttgctaccaggtctgcctttcaagaaatactagagaaaagctttaaagctaaaaagaaaagacatcaggtagtaatgagatctacattaagaaacaaagagaacagataaaagtaattatgtaggtaaatataaaatctgatattaataatttttaacagattggaatgacaactgtataaaacaatgattataatcattcaattgtattgataggcttaaaacataaagatgtaacatgcatgaaaaatagcacagctgggcgtggtggctcatgcctgtaatcccagcactttgggaggctgaagcgggtggattaccagaggtcaggagtttgagaacagcctgaccaacatggtgaaacctcgtctctaccaaaaatacgaaaaattagccagccgtggtggtgggtgcctataatcccagctactcaggaggctgaggcaggagaattacttgaacccaggaggcggaggttgcagtgagtcgagatcatgccattgcactatagcctgggtcacagagcgagactctgtctcaacaaaaaagaaaaggaaagaaaaatagcacaaaagagggaggaaggcaggcatgtaagtatagttatgatcatccagtttaaatactttgtaagtatttttaagtatgagagccatggattattaagtagcgttatttgtttttcagacatatgggatttgcttttggtattgattttctattttcctgcattttcaaaagaaaatattgtatggcattagtcatttggaattttttaggctttctttgtaatctaagtcattgtaactaagtactcaaacctgctcaattgggccgggtgtgatggctcacaccagcacttttggaggcagaggtgggtggattgcttgaggccaggagttcaagaccagcctggccaacatggagaaaccccgtctccactaaaattacaaaaattagctgggtgcggtggcacacacctgtaatcccagctattcgggaggctgaggcatgagaatcacttgaacccaggaggcagagattgcagtgagccaagagagcaccgctgtactccagcctgggtgatagagtgatactctgtctcaaacaaaaaaaactgctcaatctacaactttgtatagataatttattttcatttattgaggccattttgtgtgtatgtgtgtgtgtacacatatatacaattgttaaggtttcttgatctgtttttctttaccagtataaaatattcttgtctaaattgtgtcatgtcctctatgttgaatgttaattatattatgatatttaaattgttatatcatctttctttttaattcatatttggtggggcatccttttttattcctttattttaaattacttgtttacttttgggaaattacacattgttgaatcatttaaaaattttaatctgagaatctctgtcttttaataaatgtctctaacccatttacctttaataaatattcttatagaaaacaatcttatgttagggcctatctctggcatcttatttcatatttttaatttatcatgctttttaaatatttgtttttatttctctcttcagacatctattggatgaatgaaatatcttctactattttaaaagccattattgtattctgatcccttagaggattttttatttaagcccacattacttttccacatagacttaaagatttctaaaacttctaagttttcctaaaacaagacagctctttcagtatgctaactgttccctttagtttaccttctgaccttgatattttctagacagtttttagttcatgattataatagatattggtgttctcttattctatctcttccttccactttcttcttaatccctaaatttttagacaacaccaaactttatgaattgacttctcactatgcaaaattgttgacatggcaggcctgcagttgctatctttaaaagtcctgcttacaaggttggctcttggttggcatccataagcctgaattttgagaaagttcccattgttctcagaacaaacaagtatggctcactgtgcctcaaccatttgtacaaacaacttggtttatggtagatatctgcttttattttgggagtctggaattttggtacatgctaggcagaagctgctatatgaccagcccccaatagaaaccttggacactgtgtttgtctctcatgagcttccctggtagacaacacttcacacatgttgtcacaactgatcgatgggggaattcagcatgccctgtgtggctccactggtcattgggaaaagacacttggaagcatgcacctgatttcttctggactttgccccttgcaccttttccctttgttgactttgctttgtagtctttcactgtaataaatcatagctgcaagaaaaaccatgtgctgagtcctgtgagtcctcctagtaaagcactgaacctggggatagcgttgggaatccccagcatattcacttatattgcccatatacttttgtatagtggttctagatttattttcctagtggagcacatccttcaagcaggctttcaaaaagggtctttgtgtggtaagcattctgatgtttcatatgtcttagaacaattttattgtgccctcatagttcaggatgtaaattttcacttgaaaagtttttaccttaaacatcttgaaaatgctactctattgatttcttgtcctattgtcactatttgaaagtctaatctcagtctgattattcttcttctttgggtgatctaatctttctctatagaatattttaaaatttatttgtatttgatgttcctacattttataatgtggctagatatgcaagttttctttctctattcttttatgatcatttccagtctgagatctttaatagttctttcatttggggcaacttcaatgcattgtttcattaaatattttttaacctgctaaatctttttcttttagaactactatttggatgtttacacttatacctctcgcttccacataccttaatcttcctttttattttgaaacaatcttaaagtagcagaaaaactgaaagtacagtaaaaataacttcttttccctgaaacatttgagagtcagttacttaatggtgcccaatcacccccaatgctgtcatgtacattttctctaaagaaagacaagttcttctacataaacacaacatagccatcaaaatctggaaataaatgatgccaatatctactctaatctatttacatatattaattatgtctattttatgcatgattttaattaattctgtattatttgctatcagtcattcagtgtgagtgcagaaacatttcatgtaaatgtgatgttcactgctaggtttgatttgaaggccaaaaggaagcataggtttgttattctcatcccattaaccagctcaacttgatgggggaggtgatgcaaacctaaacagatttgtattgtcaaacctaaaacagtttaggttaagttaagctaagtgtgcatgtttgagaaatggctcaggagtgagggggaaactaatggatgggaccagctgataatctagctatgaagatctgggtaaaacacccagagagaaattcagaggagcccaagctgacacatttcattataatggtcatacagttattcaccaagaaaaacaaaattaggccaggaaaatagcaaacagatggaagcttcaaggatttggggattgttacaaagatcccaaaattaatctggatgttgttgcatctttatttcagatggcacatcaagcaactcctcttattcttttctgtttgtgcagaaaaaccagatctgtggtgtaggttttggatgtttttaggccaggcgtggtggctcatgcctgtaatcctaacactttgggaggccgaggcaggtggaccacctgaggtcaggagtggccaacatggtaaaaatccgtctctactgaaaatacaaaagttagccaggtgtggtggcgggcacctgtaatcccagctactcaggaggttgaggcaggagaatcactttaactcagggggcggaggttgcagtgagccgagatcatgccacttcactccagcctgggcaacaagagagaaactccatctcaaaaaaaaaaaagtttttaaattgacaagtagtaattttacatatttatgtgatacatagtgatgtttcaatatgtataatgtatagtgatcagatcagggtaattagcatacccgtcatctcaaacatttatcatttctttgtgttgggaacattcaatatcttccttctagctatttgaaattatattattcttatgtatgttcatcctacagtgctatagaacactagaacttattcctcctgtctagctatgacgttgtatcctttaacaaatctctcccactgggcacagtggctcacgcctgttatcccagcacattgggaggctgaggcaggtggatcacaaggtcaggagttcaagaccagcctggccagcatggtgaaacacccgtctctactaaaaatacaaaaattagccaggcatggtggcacgtgcctgtagtcccagctactcaggaggctgaggcaggagaatggcttgaacctgggaggcggaagttgcagtgagtcgagatcgtcccaccgcactccagcctaggcgacagagcaagactctgtctcaaaaaacaaaaaaatctctccctatcttccccttcccactatgcttcctagcttctagtacctgctgttctactttttacttccatgaggtcgacttttctccagatatgagtgagactatgtgttgtttaattttctgttcctggctatttcacagaacataatgtcctccagtttcagccatggtgccatgaaccacgggattttattcctttttgtggctgaataggattgtgttgtatatttgtatcatagtttctttctccattcctcggttgttagacacctaggttgagtctgtatctcggctattgtgaatagtgctgcaataaacatgggggtacatatgttgatatgctgatttcctttcctttggataaatacctagtagtgggattgctgggtcatatggtagtggagttctatgtgtaggcttttgagaaattgcaataccattctccatagtgactgtactaatttatattcccaccaacagtgtataacagttccccttcctccacaaggtcaacagcacttgttattttttgtcattttgttgttattgtagcgatcctgactggagtgaggtgatacctcattatagttctcacttgcatttccccgatgattagtgatgttgagagaacaatgaagtcatttttttcatatatttgttggtcatttgtatgtcttcttttgtgaattgtctgttcagatcatttgcccattttttaaattggattgtttgtgtttttgctgttgagatgtttgagtttcttgtatattctggatattaatcccctgtcaaatgaataatgtattagtctgttctcagattgctatgaagatactacctgagactgggtaatttataaacaaaagaggtttaatttactcacagttccacatggctggggaggcctcaggagactttaaatcatgtcagaaggcgaaggggaagcaaggcacgtcctacatggtggcaggagagagagctcatgcaggggaaactgcaccttttaaacaatcatatctcatgacaactccctcgctatcataagaacagcatgggggaaactgcccttacgatccaatcacctcctgccaggtccctcactccacacatggggattagagttcaagatgagatttgggtggagacacagagccaaaccacatcaaatactttgaaaatattttctctcattctgtagattgtcttttcaatgtgtcgattgtttcctttgctgtgcagcagctttttagtttgatataatccaatttacctatttttgcttttgttgcccatggttgtgagatcttatattaaaaatctttttgtaagatcatgaaaatgtcctgaagtatttcccctgtgttttcttctagtagttttacagtttcaggttttacctttagatctttaatccatttttagctgatttttgtatagggtgagaggcgaaggtctaatttcattattctgcatatggatatccagttttcctagcaccatttactgaagagactatcctttccccagtgaatgttcttggcatctttgtcaaaaagcagttggctatcgacgcatggatttatttctaggttctctattcttttttttttttttttttttttttttgagacagagtcttgctcttgttgcccaggctggagtgcagtggcacaatcttggctcactgcaacctctgcctcccaggttcaagtgattctcctgcctcagcctccagagtagagtagctgggactacaggtatgcaccaccatgttcgtctaatttttgtacttttagtagagatggggttttgctatgttggccaggctgatctcgaacacctgacctcatgtgatccacctgcctcggtctcccaaagtgctgggattataggcatgagccactgcacctggccctaagttctctattctattccattagtctacgtgtctgtttttatgccagtgctatgctattttggttactagagcttggtagtatatttagaagtcttgaaacctgttccctccagctttgttctttttgttaaggattgctttggctattctaggatgtttgtggttccatacatattttaggatttattttatattactgtgaagaatgtcactggtattttaatagggattgcattgactctgtagatggtttagggtagtatggtaattttaacaatattaactccttccatccatgagcatgggaagtttttccatttgtttgtatcctcttcaatttcttttatcagtgttttgtagttttcaatgtagaagtcttttatctccttggttaaatttattcctaggtatttatttgtagctgttataaatgggattgccctcttggtctctttttttaactagttcattgtgcatagaaacaccactgacttgtatgtttattttgtatcctgtaactttactgaatttctttatgagttctacaggtttcttggtagagtctaagtttttctctacataagagcttgtctgcaaacagggtaaatgtgacttcctcttttccaattttgatgtcctttattgttttctctttcatgattgatctaactaggacttccagtactacgttgaataagagtgggtaaagtgagcagcatgctcatggaggggcatggaggctccctagcctttcctctatatcttgtttcagttcttagaggaaaagttttcagcttttcaccgttaagtatattgttagctgtgggtttgtcatatatgatctttattatgtggaggtgctttcctttcatacataatttattgaaagtttttatcataaagtggtgttgaattttatcaaatgctttttctgtatctactgagattaccgtatggttttgtccctgattctgttgatgtgaagtatcacatttattgatttgtgtacattgagccattcttgcattcgtatgataaatcccacttgatcatgccacattatctttttgatgtgttgttgaattgggtttgttagtattttgttgaggatttttgcacctattttcatcaggaatattggcctgtgggtttctttatgctgtcttgttattgtctggttttggtattaaggttatgtgggcctcataaaattgagctaagaagaattcctgccgcatcaattttttggaatagtttgagaagaattggtattaatttatatttaaagggtcatagaatttggtggtaaagccatatggttctggacttttgtttcaggggagactttttattactgattcaatctccttacttgttattcgtctgttcaggttcttctgtttctttttggttcagtgtggtaggttgtatgtgttcaagaatttatccatttcctctaggtttttgaattataaaggatatcacaaaggatacagaggaagaggtgcataaggtgagatatggggaaaggctagagagcttccatgccctccatgagcatgctgctctccaacaacctctaagtgttcagtggtagccacctggaagctctgacttatatattttaatttgaaatttctgttcagttttgagtaattgtctttttttagactaatttctaattatttccattatagtctgaaactatgtcctttgtgatgtaattctttaaaattttgttcagactttttttatagcctaatgtatagtcactttttgtacatgttttatttgtgcttgagaaaaatgtgttcctctagtttttctatgcagacttctgtatattttaattaagtcaagcttattaatcataatgttcaaattacccatctctttactaaatttactactctatcaataatttgaatgtataaagtatagaccttctatatacccataaatctttccccttataaatgtcagtacttgagcctgccacaatgttgactagactgctttaacagaaagcctccatcacataataactgaaatacaatatactttttatttcttgctcaaataataattcaaaatgagtattctaaaacaatgggtatccttttttcatgtgataaaagaagtcaaggacccaggctcctttcaccttttggcttcactaggctctagaaccttgttgtcatctatactgagctggtggaaaagaaaaagagtgtgaaagagacttgccatcttcttagggtcttgacctagtagtgacaagtctgttagccaaaatatttacattgtggcactggctgcaagatgcttgggtaaggaaaatgcagcttctatttgagatgatgattctcctctatataacccctctttgctaggatagttatgacagtgtccagtctctaaattgttcatttatgagtggacaaaaagaaaaactaggaaagagagagcctttgggaagggtcaaataccactctgtaaactataggtacaaatatcagaatttttgaattataaaggatatcgcaaaggatacagaggaaggtgcataaggtgagatatgggggaaaggctagagagcttcctttgaatgtaaattacaactgtggactgaaggagtctgcattaggagttcagaatgtcagaaagaggttcaaatctttagaagattatcatcatcagaggaagagggtgatcttcttcccagcttgcatgcctactgggagtccagtgaccctaggttgtcccctctttctcctgttagggaagaagaaacatcttcacttctgagagttcatttccttcatgatattcaaggtcagtgaccacctcctcctggacagcctgccaagcctttgactgataggtctctccccctgtctgagctctaagatatttactatgtttctccactagcccttctgtcccatgccctacaatagtctctctttctgtgtgtttatgtgtgtttaaatttgtatatgtatatctgtgtatgtgtttatatacatttatatatgaaacagctacttactctttcactcaggaattctagctctcttagtctaaagaaatcaaagatttataaataaaaataatatgacattctctagattattagtaattagtacaatacaaatacttgattattagcatttgagagctgtgcaattatgaaaatccacattttgagaaatacttacatgattaaataagggtggcaaaaatagataacaaaagttgtttatattaaaaggattgtttatattaaatatggagagaaactaaaagataatgcaatgaaacatcagttaattctaagcaactctttttaacaatatattttttcttttcttttttccataaaacattttgtaattagaaagcagaaataaatgatatctttcattctatcggcaagaacacaagactggttatgtgaaaggaggaggcgtcattcctgcggaagccctatcccacatgacgaacgacaaggccaggggcaagcaaaaagaggaaggactctcttgctctgctccgacttggccagtagaggcagtgaggagctaaagatcattccttctttccttccttcactctccgtagacagctctgcagggaagtctgtgacaacctggccagacatagggctcacgatctgatcagagtcatggcaccccagactctgctgcctgtcctggttctctgtgtgctgctgctgcaggcccagggaggataccgtgacaagaagaggatgcagagtaggtgatgggctgctggatgggtgagggggaattgggtagggggaatggagggcctgtgtccagtctgagtaggacctaggagttggaaactctctgcatatccagctctgaccacaatgttgtgtagactctggactgtccctaaaccatggccctccagccccttagctggccctgggaatagtaatgggaatgaagaagaaacctgcatattttgctgttccttctcaatacttagagagaaatggcacatcccatagtgaaaggcgcaccagggctgagaatccagtggggaaagcaagacaattattatttgatttatgcacatttgtgaggagtaaagattcagaagtggttatgacggtaggtgtaggtgtagaatgggtataagtgtagggaaataggacataagacaagcaaaagttggggtacacagagccaagttaaggttatcatcaaaggggcaaggagagtggtggtggaaagggaactaaagaaggggcaggaagactagagacagtgacagtgagcagaagagagggagagacaagaggcatgttgatcctcatctctgaattctactattcagagactaggagagagtttgaaagatgtctcatgcttctttgagctctcaggatcagactgtagattctttggtggtgacttcaccaaggccatgactagtaagggagatggagttctgattgctggtgtgtggagaaggtccaggaagcccaggcattgtggtctaatggggtaaggtgtacagtggagagacaggatttaaaatatgaccaatcactaggatttggtgatgggcaggaaggtagttctatgaagaaggaatccaggagtatcatgactgagacctgggttcaagggtcttggaggaggcttcagcttgagaaaaatgttctctaggaaactgcgtttatttaccgttctattctccttgtcagaaacacagctatccccagaaatcaaagtctgccagcagcagcctaaactatatctatgcaaacacttatgtgaatctcaccgagattgtcaagcaaataacatatgctgttctacctactgtgggaatgtttgcatgagcatcctgtgagtgggagagtgggctgggatgtgcatcctgcttcccaactcctctatccaagactgtgcccacatccgaagcacaaggacctcaagtcaccagcataagaacatcaacaggaatgccgccctctctactgtctgaaccccttgtccctgtcaaataaaccagaacaaatgcccagggatcctacctcttttgctgccactacagatgatcattgagagctcactgtggcccctacagatgccccacttgtcttgcgtcctggtgttcaatttctctccctggctatgcttctctaccctccctctccctctttggcccacgtatccctgccagccctcaggatgcccagccccttgctgttttgctcactgaaccagtactcccagggggaggaactgctcatgtgcagcatctcctgatgctaaggagaacatttctcaccctggagtcagaaggacccattaagcatgagatgggtggcagttagaacccgagataaagagtgggaggcccccaagcactgctttggtctccttagccttggtgcaccgccatcctatgctccccaatctctctgtaaggttcagattactgtctatcattaggataatgagtcccaggaagtccagcaagcccaaggccacaagagagtgagaggatatgatgtgactggaagagggtgtttcctctaggatcactttttcctcacttctctccattacctgagaccagaggcatcctagtgagagtgagtgcctgcaccaaccccaaagctcctcctatccagcacccaccaatatggctactcctctgatgggacccattttgggcctcaggatctgacactccagcaccttccattaactgaatagtccttatctttcccaagccctcttccttaggggctggttcattctcttttctttagatcaagaggaacactaagggatgtggaacaggtggttcatgctgctgttgctaaggagtaattggcacagagtggctatgggtcttccctgtcatcctactgtgagttggtggaaattaatcagtgtggtacagaatctcccactctgcaatcgcaactcctctgaaatgatcctggggctagatccagggttgggtcacatgtagctaactgggacatgaagccaaatgtgaagaggtttcaggaggataggccatgcccagaggcaggtgtgcagtgttatgctccagtctagtgcttcttgctgggccattcaatgaaagagacatcagagaagaaaacttccttcatcagaccagaggctgtgagccacctctgaggcatcaccgggctctgggtatctcaggcttgtcttcacctttctcaagagcttcccttggacaaggaggtcttaggaaagagatcatgatcaaccatcaacacagacaccatcagatgtactctgtgggctgtaagggcatgatctccaagagaccttatttggtgtttccttggatagcctcccttaccaagcatcctctcaagccacccccaaacatgcctactagacactacaggcatatcttgttttattgagccttgctctattgcacttcacagctatagcgtttcatacaaattgaaggtttgtggcaactctgcatcgagcaagtcatctggcaccatttttctaacagcatgtgcttacttcatgtctctgtgtcacattttggtaattctcaaaatatttcaaacttgctaggcgcagtggctcatgcctgcaatctcagcactcgggaggccaaggcaggtgaatcacctgaggtcaggagttcgagaccagcctgaccaacatggtgaaactccgtctttaataaaaatacaaaattagctgagtgtggtggcgcatgcctgtaatcccagttacttgggagactgaggcaagagaatcgcttgaacctgggaggtgaaggttgcagtgagctgagatcttgccatagcactgcagcctgggcaacaagagcgaaactccatctcaaaaaaaaaatttcaaacttgttttattatcatatctgttgtgatgatctgtcatccataatcttggttattactgttgtaattgttttgggacactatgaactgcgcccctaaaaaatgattaatggataaatgttgtgtgtgtgttctgactgctccaacaactggccatttccccatctctctccctctcctcaggcctctctatttcctgagacataacaatattaaaattaggccaattaataactccacaatggtctctacgtgttcaagtgataggaagggttctatgtctctcactttaaatgaaaagctggaaatgattacagttaggaaggcatgtcaacagcaaagatatgccaaaagctaggcctcttgtgccagttagccaagatatgaatgcaaaggaaaagttgttgagggaaattaaaagtgctactctagtgaacacatggatgataagaaagcaaaacaaccttattgctgatatggagaaaattttagtggtctgggcagaagatcaaactagccaccacattcccttaagccaaaaacctaaccagagaaaggctctagctccctccaatattatgaaggctgaaagaggtgagaaagctgcagaagaaaagttggaagttagcagaaattatttcatgaggtttaaagaaagaagccatctccgtaatataaaagtgcaaagtgaagcagcaagtgctaaggtagaagttgcagcaagttacccagaagatcttgcaaagtgatgaagatgtctaaattaaacaatagatcttcagtgtggaaaaataagccttctgtaggaagaagatgccatctaagactttcataactagagagcaaaagtcaatgcctggcttcgaaacttgaaaggataggctgactctcttgttaggggctaatgcagctggtgactttaagttaaaggtaatgatgatcatttaccattctgaaaattccaagtcccttcagaattctgctaaatctactatgcctataaataagacaccatcttgatgatagcacatctatttacagcatggttcactgaatattttgagtctacttttcacacctagacacattttgagtctacttttgacacctagacacctactgctcaaataaaaaatactcattcaaaatactactcccattgacaacgtgcctggtcacccaagagctccaatggagatgtacaaggagattaatattgttttcatgcctgctaacacaatatacattctacagcccatggctcaagaagtgatcttgactttcaagtctcattgtttaagaaatacatcttataaggctataggtgacatagatagtgattcttctgatggatctgggcaaaataaattgaaaaccttctggaaatgattcaccattctagatgccattaagaacattcatgatcgacaggaggaggtgaaaatatcatcactaacaggagtttggaagaaattgattccaactctcatggctgactttgagagtttcaagacttcatagaggagcccactgcagatgtgatagaaatagcaagagaactagagttagaagttgagcctgaaaatgtgattgaattgctggaatctcatgataaaacttgaatggatgaagggttacttcttttttttttaagagataggatcttactcagttgcccaggctggagtacagtggcatgatcagagctcactgcagtcttgaactccttggcttgagctatgctcccacctcagcttccctggtagctagaactacaggcatgcactactgcccttggctttttttttttttttttttttttttttttttttttttggaaagacaaggtctagctaagttccccaggctgatctcaagttcctggcctcaagtgatcccctcctacctcggcctcccgaagtgctgagattattataggcataagccatggcacccagtcaaggagttgcttcttatggatgagcaatgaaagtggcttcttgaattagaaacttctcctggtaaggatgctgaaaacatttttgctacttgggaggctggggcaggaggatcacttgaacccaggagtttgaggctgcagtgagctatgatccttgccactgcactctagcctgggtgttaagacaagaccctgtctcttaaaaaaaaaaaatagcaactcttcatccatgaaagttgtatcattagactgttgaaatgacaacaaaggatttaaaatgttacataaacttatgataaagcagtagcgggatttgagaagattgactccaattttcaaggaaattcttccgtggaaagaaattcaaacaacatcacatgctacagagaaatctttcatgaaagaaatagtcaactgatgcagcaaactttattgttgtcttattttaagaaatttccatagccactttagtaaccaccaccctggtcagtcagcagccatcaacattgaggcaagactctctaccagcaaaacaattatgactaactgaaggtcagatgatcactagcatttttagcagtaaaatacttttaattatatacactgtttttaacatataatactattgcacacttaatagattatggtgtagtgtaaacataacttttatatgcagcaggaaaccaaaaatatgtgtgattctctttattgtggcagttggatccaaacttgatctctaacgtatatctgcattaagagaggcaaagttagccaggcacagtggctcatgcctgtaattccagcattttgggaggccgaggcaggtggatcacctgaggtcaggagtttgagaccagcctggccaatgtggtgaaacctcatctctactaaaaatataaaaattagccaggtgtggtggcgcacacctgtagtcccagctactcaggaggctgaggcaggagaatcgcttgaacctgggaggcagaggttgcagtgagccgagattgcaccactgcactccagcctgggtgacagagggagactccatctcaaaataaacaaacaaacagaaaaacaatgagaagcaaagttacctgccagtggccacatggagagtaaacttccatgtccaaatccagagcactttgccatgtaaacacactatgggttccaaactgctctatttcctgtcactggtgcaagtgccatgaactatgaattttactagaagcagttgctccaatcactgatgtcctgacctatgttccagagagctctctggacagcctaccctgccccagggaactcagaggctacacctagaatattgcagctggaaagggtgcccatttggttatgactgtgtgctctgtcttatatggaagcatctgtatacctccatattatttacaatagggtggtgaggaatcctggaagactttgaacctcatggagatataggaggaatcaaatgcctattctgccaaaatctggatctccaaaatgttaagtcctagtcatcagagaatcacagatgaggtctggcctgttggtgaccaaatgcaagtcttatgattcccactgcttttgcattatttgttctcttcctatgctccagacatgccccttcaagatggcgaatgcagatgggaggatcctaaaagaatactccccacctctgatgtcatggtattggccagctcctgcatcatttccatactttggccacagctgatgctcatagtgagtccataactgatgctgtcatcagcaatatgtgccccacccaacctctagttcatcctaacaaacctaggatgcctaaatcatgcagtacagaaggttatctgaaatgcaagggttgggtttaggtgctaagtgcaatatctatcaccaagaaaagtccattagccaaaaatatagttgcaataactatgacatgaagcattcaaagatagtcttctatccagaggaagtctcttataactctcccattaaatatacattctttagaattatacccatcagttaatgtgtccagtgtcttaacttgggaagagttcacttcttgaaaatttttagtgacagatggtaaaatgtagaagtaagtatctgagtgaaagggcactaaacttcagatttctgaggctattctggatcattgtggctagtacatggtgacaccttgccatgttgattcaagtattctattatttaaagtcttcttggattatagtttttaaattaatttatttatgttttaattgacaaaaaattatatgtatttatcatgtacaatatgatgttttgaaacctggatacattgtggaatgatattgtggaatgactaaatctaactaatatatgcattacctcacttattttttatggtgaaaacactcaaaatccactctcttagtaatcttcaggaatacaatacattaactgtagtccccatgttgtacagcaaatctcttagctcacttctcctatctaactgaaatattgtatctccaacatctccccagcatccacccctcagaccccggtagacaccattctaccttgttcctgtgaattgaatttctttggatttcatattaaagtgagattatgtgatatttatctttctgtgcctgcttattttacttaacataatgctctctaggttcgtcatgttgttgcaaatgacaggatttccttctttttaaaagctgagtaatattttattgtttatatatgttgatgcttccatgtcttggctgttacgaataacactgcaatgaactggagtgcagatatctctttggcatactgattttatgttccagtatgccaaagagtatccagtagtctaattgctggataatgtggtaattctatttttgttttttttaggaacttccatactattttccatatgggtatactaatttgcattcacaccaacagtgtgcaagaattcccttttcttcacatccttgccagcccctaggatattctgtctaattgataataaccattccaacaggtaggtgtgagatgataactcatcatggttttaatttgcatttctctgatgattagtgatgttgagcattttttttcatctacctattggctatgcatgtcttcttttggtcctttgccaattttttaatcaggttgtttgcttgctggtgagttgtttgagttccttacatattttggatattagcccttatcagatgcatggtttctaagtattttctcccattccataggttgtctcttaactctgttagttgttttctttgtggtttgatattatcccacttgtctagttttggttctcattgcctagaccaatgtaatggagcttcccttctatgttttcttctagtacttttacagttttaggttttaggttttacatttaattatttaatccatttagaattgatttttgtatatgatgtgaaattagggtccaatttcattcttctgcatgtgagcatccagttttgccaggaacttttattgaagaggctgttctttgccagttgagttttattggtatctttgtcaaaatcagttgaccataaatgattctgtttgtttctaggttctctgtcatattcctttgatctatgtttctgctttaaatgccagcattatactgttttgatttttataactttgtaatatactttaaaaccaggtagtgtgatatgttcagctttcttgtttttgcccaagatagttctagcaatttggggtctttgggattccatataaattttaaggtttttttctatttctgtgaaaaatgtcattggaattttgatatgattgcattgcatctgtagaacactttgggtagtatggacattttaacaatattattaattcttccaatctgtgaaaacagaatgtctccacttatttgtgtcttcttcaatttctttcatcaatgtttcagtttccagtgtacaagtttttaacctccttgtttaaatttatttctaagtatcttttttttgctagctattgtaaatgggattgtttcctagacttcctttttgatagttcatttttactgtatagaaatgctactgattttttgtatgttgattttatgccctgcaactttatcaaatttgtccattatttctaaacagttgttttagggttttctgtatatcagagcatgtcatctgcaaacaaggacaaattaacctctttcttttcagtctggatgccttttatttatttatttatttttttttttttttctttttttttgagatggagtctcgctctgtcacccaggctggagtg[133 bp omitted]gagacggggtttcaccgtggtctcgatctcctgacctcgtgatccgccctcctcggcctcccaaagtactgggattactggcgtgagccaccgctcccagctcttgtattctctgcctaattgctccagctagcactttcagtactatgttgaatagaagtgacaagaaagagtgggcatccttgccttattcctgacattagaggaaaagttttcaactttccaccattaagcctgatataagctgtaggcttttcatatatggccttcattgaattgaggtacgttcctcctttacctaatttgttgaaagttcttatcatgacagcgtgttgaattttgtcaaatgttttttctgcatctgaggagatgatcatatggtttttgtcctttgttatattaatgtggtgttatcacatttatggatttgtatatgttgcatcatcgttggatcctagagataaatcccacttgattttggtacataatatatttaatgtgttattgaattagttggctagtacttcgttaaagattcttatatatgttctattaggctgttcttgcgttgcaaaaaggaatactcaagattgggtaatttataaagaaaagaggcttacttggctcatggttctgtaggctgtgcaagcatagtgccagaatgtgtttggattctgggaaggcctcagggagcttttactcatggcagaaggaaaagcaggagcaggcacctcacatggccagagtgcaagcaagagagagagggggcagggaggtgccacacatttttaaacaaccagatctcatgagaactcatcatcatgaggacagcaccaagccatgaggggtctgcccccatgacccaaacacttcccaccaggccccacctccaacactggggataacaattcaacatgagaatttgttggaacaaatattcgaaccatatatattcactatgggtattggcctataattttctttctttttttttttttctcacgcttaattcactttatttttcttgtataaaaaccctatgttgtagccacagctggagcctgagtccgctgcgcggagactctggtgtgggtcttgatgaggtggtcagtgaattcctcatagagagacttggtaaatacagtctccttccagaggtcggggggcaggtagctgtaggtcttagaaatggcatcaaaggtggccttggcgaagttgcccagggtggcagtgcagccccgggctgaggtgtagcagtcatcgataccagccatcatgagcagcttcttaggcacaggtgcggagacaatgccagtgcccctgggtgcagggatgaggcgcaccagcacagagctgcagcggcctgtcaccttgcaagggacggtgtggggcttgccgatcttgttgccccagtagcctctgcacacggggacaatggagagcttggccaggatgatggccccacggatggcggtggccacctccttggagcacttaacacccagaccgacgtggccattgtagtccccgatagcaacaaacaccttgaacctggtgcgctggccggcacgggtctgcttctgcactggcataatcttcaaaacctcatccttgagagacgtccccaggaaaaagtcaatgatctctgattccttaatgggcagggagaagagatatatctcctccagggacttgatcttcatgtccttgaccaagcggcccaacttggtgacaggcatccactccttatcctcgggcttgccttcgcgagctccgcggccttggccccggccccgtccacggccgcgaccccggccccggatgccactgccgaaacctccgcggaagccaccgcggttccccatcccagggccaccagggcctccgggcctccccgctgcaccggcgtcatccgccatttggtgttttctcggaaaagaagtaattttctttatttgtagtgtccttgtctggatttagtatagaggtaatgctcaccttgtaaaatgagtttggatgtatttcctcttcttccattttttggaagattttggaaggatcaatattaattctttataaatgtttggtagaattcagcaataaagtcatcaaatcctgggctcttttttttgataggaggcttttattattgattcaatctccttactttttattggtcctttcagatttccagtttcttcatgattcagttttgataggtttatgtgtctaggaatttatctatttcttcttgcttgtataattttttggtatataattgtttatagtagtctcttacagtacattgttgtttatctggtatcagttgttatgccttttttctttgtgatttcatttattttagtcttttccctttatttttcatagtctacctaaagttttctcaattttatttagcttttcaacacctgactcttagtttcactgatcttttctattatttttctattttatttatcacatctatttttgctctggtctttattatttttttccttctgctaaatttggacttgtttgttcttgtttttctacttccttgaggtataacattagattatttcagatatttctacttttttgatgtggatatttattgcttatctaaactttcgtcttagagttgcttttgctgcatcccctaagttttagtatgctgtgtttccagttttgtttgtctcaagatatttttaaatttcccttttaatttcttcattgacccactggttattcggagcatgttgttcaatttccacgtgtttgtgaattttcagaaattcctcctcttattgatttctagttttataccattgtggtcagaaaatatagttgatatgacttcagtctttgtaaatttgttgaaacttattttatggtcaaatatattatctatcctggaaaatgttccacgtgcacttgagaagaaaatatattcagctgctgttggatggaatgttctgtatatgtttgttagcccatttggtctaaaatctagttcaagtgtgttgttttcttgttgattttctgtctacatgatctgctcattgctgaaagtggggtattaaagtcccctattattatacattatagtgtaactctcccttcagatcttttaatatttcctttatatttagatgcttcagtattggatgaatacatatttatcatcgttatattttcttgatgaattgacctctttatcgttgtacaatcattttctttgtcctgtattacagtttttgacttaaggtctattttgtcaatataaacatagctacccttgagctcttttggtttctctacctttttctacctctttaccttcagtctatgtgtgtccttaaaggtgaagtgagtctttttcagacagcatataaatgggccttgttttttatctattcagtcactctatgccttttgattggagaatttaatctattacattcaaagcaattgttgagaaggaagggcttactactgccattttgttagttgttttctggttatttcgcagatcctttattcttcctctcttactggcttccattgtggtttgatggttttctgtggtgtgatttgaatctgttcttttaatcttatgtatgtgtgctgttggttttcactttgtgtttaccatgaggctttcaaaaaacatcttagagttataataaactatttaagctgataacaatttaacttcgataacataaaaaactataagattttttgggcagagcggtggggggtgatgggtgcagtggctcatgcctttaatcccagcactttggaggccaaggcaggtggatcacttgaggccagcctggccaacatagaaaacctcatctctgctaaaaatacaaaaagttagttgggcgtggttgcacatgcctgtaatcccagctactcaggaggttgaggcacacaagaatcactggaacccagaaggcagaggtggcagtgaaacgagatcattccactgcactccagcctgggcaacagagcaagactctgtctcaacaacaacaacaaaaatacgatacactttttctctactaccaccatgccctgcattttaaatttttgatatcacagtttacatctttttatattgtgtgtccctgaaaaattattgtggctattaattttaataataactttgtctttcaaccttcgtactaaagatatatgtgatttgcacaccaccattcagtattagagtattctgaatttgactgtgttcttactttgaccgttaagttttatatgttttatgttgctaattagtatattttactttaagcttgaatattccctttagtatttcttgtaaaatcagcctggtgatggtgaactccctcagcttttgtttgtcttggaatgtctttatctctccttcatttctgaaggatagctttgcagggtgtagtatttgggcttgacaggtttttttcctccagcattttaaatatatcatcccactcgctcctggcatgtaaggtctgccaagaaatctgctactaaccttattggaactttattatgtgagatttttttattttcttttgctgctttcaggatcctctctttgtccttgatttttgacagtttggttatcaaatgtcctggtgtagtcttgtttagattgaatttcattggacaattttgaccttcctgtacctggatatttatatttgtctcccaatttggaaatttttctgctaatatttctttaaataacttttctacccctttgtctttctcttctccttcatgaactcccataacttggtatttgatcttttgatgctgtcccataaaccctgtcagctttcctttttgttgttgttgagttttgtttgtttgcttgcttggggcttgcttgtttttgagacagggcctcagttctgtcacccaggctggagtgcagtggcacaatcatggctcactgcagccttgacctcccaggctcaagtgacactcccacctcagccccccaagcagctggagctgggactacagatgcaagccaccatgcccagctaattttttttgtagagggcatgggtctcactttgttgcccaggctagtctcaaactcctgggctcaagtgatactcccacctcagcctcccaaaatgctgggattacaggtatgagccactacacccagcaatcttataagttttctttattccttctcattctctttttctcctctgactgtatattttcaaataacctatctttaagttcacaaatgctttcttctgctcaatttcttatctattccatttttcatttcattgtattttttagctccagtttgatatttgatttctgtttgatatgttctataatttcaatctctcattaaatttatcattttggtcattttattgtttgcctgatttgattgaattgtttctctgtattttcttgaagttcactgagtttccttaaaacaattattttgaattgtctgtcaggcagttcatatatctccattcctttggtatcagctactaagagatcactgtattctttttttttttcttttttttttttttattgatcattcttgggtgtttctcacagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactctcaatgagcacgctgcctttaagcatctgtttaacaaagcacatcttgcaccacccttaatccatttaaccctgagtggacacagcacatgtttcagagagcacagggttgggggtaaggtcacagatcaacaggatcccaaggccgaagaatttttcttagtacagaacaaaatgaaaagtttcccatgtctacttctttctacacagacacggcaaccatccgatttctcaatcttttccccacctttcccccctttctattccacaaaaccgccattgtcgtcatggcccgttctcaatgagctgttgggtacacctcccagacggggtggcggccgggcagaggggctcctcacttcccagtaggggcagccgggcagaggcgcccctcacctcccggacggggtggctggtcgggtggggggctgacccccccacctccctcccggacggggcggatggccgggcagaggggctcctcacttcccagtaggggcggccgggcggagacgcccctcacctcccggacggggcggatggccgggcggggggctgacccccccacctccctcccggacagggcggctggccgggcagaggggcttctcgcttcccagtaggggcggctgggcagaggcgcccctcacctcccagacggggcagctggccaggcggggcgctgacccccccacctccttcccggacggggtggctggccgggcggggggctgacccccccacctccctcccgggtggggcggctggccgggtggagacgctcctcacttcccagacggtgtggttgccgggcggaggggctcctcatttctcagatgggacggttgccaggcggagggtctcctcacttctcagacggggcggccgggcagagacgctcctcacttcctagatggggtcgcggctgggcagaggcgctccccacatctcagatgatgggcggccgggcagagacactcctcacttcctagatgggatggcggccgggaagaggagctcctcacttcctagatgggatggcggctgggcagagacgctcctcactttccagactgggcagccaggcagaggggctcctcacatcccagatgataggcagccaggcaggacgctcctcacttcccagacggggtggcggccgggcagaggctgcaatctcggcactttgggaggccaaggcaggctgctgggaggtggaggttgtagcgagccgagatcacgccactgcactccagcctgggcaccattgagcactgagtgaacgagactccgtctgcaatcccggcacctcgggaggccgaggctggcagatcactcgcggttaggagctggagaccagcccggccaacacagtgaaaccccgtctccaccaaaaaaatacgaaaaccagtcaggcgtggcggcgcgcgcctgcaatcgcaggcactcggcaggccgaggcaggagaatcaggcagggaggttgcagtgagccgagatggcagcagtacagtccagcttcggctcggcatcagagggagaccgtggaaagagagggagagggagaccgtggggagaggggagaggggagagagaggagagaggagagaggagagaggagagatcactgtattctttggtgttctccttgtatttttttttgttattgccttacattaatgtgtgtgcatttgaagaaataaggacatttcagtctttgaagactagttttttctggggaagccctttatcagtcatccggaggttcgggagaggccatctggcatgatcccaggtcatacttgctgctagagtcctcaggcaggctggcctggttcctgggtcaggaggtgggtgggcctggtgcttgagtccacagggttgggcctgaaggctggatccactggggtgaatttgttgattgggtctgcaggaatggtgttggagccagggttcaagaaggcaggcctggaccttgtatcagtgaaggccagcctcatgcctgggtacacaggagctaacctggctctgggatggaccgtgagcctgaatctacagggtctggccaagttctgggagggggatggcacctgggactattgagatgggtctggagcctgagtacctcagggctgtcctggagcttatgtctgcaggggtgttcttggagcctcagcctatgggatccggcctagaactgagttctactggggtgggcctggaccctggatctgctatatcaggcctggactctgggttcactgggccttgggtgcacatggactggcctggagcctacagtcaacctggtactggggctagtgtggagtttggttcacaagggctggtctggagcctcaagatcatgggcactgacctggtgcctagagtcactggagctgtcctggagcctagagccaagaagcctggtccagctctggagtctactgagactcttggaccttcagtcaaatggagggtggtgctatggagactggcctggcactgtgcaggcctgagcctgtgtctgtaggtatcttcctggtgtttaaggccagggatgctgatctggcactggaatgggtgggaagcctgaggccacgggggttggcttagtactgagtggtcctggatcttgtatttgtagggcctggcctggaggctgagtctgcacatgctggtctgaggagtagggctgtggaaatcaacctggtgctgaggtagacttgaagcctgaagctatgagggccagcccagtgctggagaaggtccagagcttagggccttggggtctgcctggccctgggatgggcttagaacatgactctgttggggctagcctgaagctaggactgctggggcctgtctgccactggggccgctagggttgagctggcactagagcagacccagagatcaagtctactaggcagacctggagcctggggctgctgaggtcagcctatttgtaatttctttcttctgacaattagaaaccttactcaaattatcttccagttatttacttatttgtttaaacttgtatatatggaaagtagttttagaattgtttatccatatctctgtgagaaaccatttaccagacacctgctctctaaacaactgagtgaaagtgctactgaaaattccccacattaaaaatgggacagaaataaaattctgttctgtgaagcccatgaaattagcttatcagttctaagcttatcagatgggacagcaaaagttggaaggtagtctacaatgtaggagaggaacaatactggggatttgtaataagggtactcatgggtggtgggatgagctgaaaaaaggcaaggccactactggtaaataagtttatttgtcaagtgtttgctgttgtccagctctcagtaaaaatagactggtgttcctaaaagtagccacagggtactactatgagacctcttaaacatttcccagcccacacaggtggcagcctggtgggaagctacggttttagtaatctccactggtttcctgtaaaacaaaaaggttagatttttagaggctagagaactctgagaaacaagcattcattccccctgcttaatagtatccatgttcaccagacaatgggacaagaatactttaacgtaacaacaggagttgtccacttctgagtaggtgaggtattggacaaaaaaaggtggagactttgggcctggctgagccaaatggcccatgggaaagtctgactatggaagcagtggttagaaatctggacaaatttaggaaaaatagcaaactatggtgtaatacaaagaagacaacacagacaggtattgattatataatgaaagaaacaatggggtctaagctggtgtcttgatttactcgccagtgaattgctttccaagttaaagggacattgtcttctgttatttttgtacctagaatttggggtacctcagtcttctgtttaggaataacagcctccgagaagggaatgagaatcagtgaagatatacacccaagcaaacatctcccaactcacgacgtttatccagcagatgtttccacaataggtccagcagcatgtgtaatttttgtctttacatctaaaggctttagaacacttattggtacattctttgacatttggctttccccagcattcttcaagtaacaattccttccctgaaattgagatgagatggtcaaaggttgatggtatgtttcagccaagagcggaaagaaaggcctttcatacgtttaacagttcctcctggaatctgggccccaaattccaaccaagatatctatttgccttttaagggaattgccttcatgagcctcctcaaattcctgtcattatacattcactgaccctattgcatcttcactgacttcttttccttctcgacctctgcaggctttaccagtgttgcaggcctctgggccctctctgagcatcccaacgataaaactcagtcaacccggagcattcatgtaacctcctataaaatctgcatttacataacaggagatctcagggcccggcatatcttgtagcctcattgcaatgcctatttcacagagtggggagctaggccaggtcaagtaagaaacagattctctccctttttctttccctacttgctgactctgtgtttaataactcagcctctcttcaaattcttatctctctcactcagttttcttagcccctctattcaccccattttctcatcatatgacccccaaggttgccccactaagaagggatctcaagcctctttcctaacttttcacattctgaaagccttgccactgaaactaagggtatgtattaagaaatgcccatttggtactcatatgacaaagtatatgcagctagggcacagggataccagtatagagctacaggattagctctatactgacatctgaccctcaaagacagcctaacattggaaaatatttttatgtttatagcttatggtatatatacacacacacacacacacatgtgtttgtatatatatagagagagagagagagagacagagagagagagatagacagatattgctattttaaaggttaaaagaggaagcattgaaggacctcagcttagggatttcttgaatctctgtgcatacaaaattgtcattctctgatgggtgatactacgaaggtgggtcctgagtcagatacagcggacaatgaaaccccctcccttgttcagaaacaagctcatccccctcctgtggcccctaatccagcctcaccacctactgtcatatcttttcttcctcatttctcccagcacagacagtagcaccgtacagaagaatgtcatgagcatgggtatccagagcttcatgaggctgaccatatgtgtctgaatatgtgttgtcagaaggattatttttcttcccagtcgctgctagagatcaagacatataaatagggaaagagaggtgtgaagcaagagaaagtgcttgtcgaatttcttcattctttatcttctcactattccccctaggcctctgcctacccaacaactggcacacctaagctgagcgttggctttgccaaaaggaatccctccatctcacacctcatgttttccttttgctggaaaaaaaatataatgtgttgccttattttgattaaaacataattcaaattcagcttacaaaaaaatttttttaaatcgtttattttaggtttggggtacatgtgaaggtttgttacacaggaaaacttgtatcatgagagtttgttgtacagattatttcatcacccaggtattaagcccagtacccaacagtcatcttttctgctcctctccctccttccacccttcaccctcaagtagaccccagtgttggttgttccttctttgtattcatgagttctcatcatttagctcccacttataagtgagaacatgcagtatttggtttgaacaaaattctttttgaaaatgtattcaacatttattgaacacctactatgtgcccagcactattatacaccatatatatagagagggtccttaacttatgatggtttgacatacaacttttcaactttatgatggtgcaaaaggcaatatacatccagtacaaatcgtactttcagtacccatcaaccattctggaggggttttttttgttttgtttgtttgtttgtttttgttgttgcataatattccattctgtgaatatgtcacacaatatttattcattttcatgaaaatgaacatttaggggctgaataggaacagctccagtctacagctcccagcgtgagcgacacagaagacaggtgatttctgcatttccagctgaggtaccgggttcatctcactggggagtgtcagaaagtgggtgcagcacaccgagcatgagccaaagcagggcaaggcattgcctcacctgggaagtgcaaagggtcagggaattccctttcctagtcaaagaaaggggtgacagacggcacctggaaaatcgggtcactccgaccctaatactgcgcttttccaacagtcttagcaaatggcacaccaggagattatatcccatgcatggctcagagggtcctatgaccacggagcctcacacattgctagtacagcagtctgagataaaactgcaaggcggcagcgaggctgggggaggggcaccctccattgccgaggtttgagtaggtaaacaaagcagccaggaaacatgaactgggtggaggctaccacagctcaagaggcctgcctgcctctgtagactccacctctgggggagggcattgccaaacaaaaggcagcagaatcctctacagacttaaatgtccctgtatgacagctttgaagagagtagtgtttctcccagcacgcagctggagatctgagaacagacagactgccttctcaagtgggtccctgacccccgagtagcctaactgggaggcactccccagtagggcagactgacacctcacacagctgggtactcctctgagacaaaacttccagaggaacgatcaggcagcaacatttgctgttcaccaatctccgctgttgtgcagcctccactgctgatacccaggcaaacagggtctggagtggacctcgagcaaactccaatagacctgcagctgagggtcctgactgttagaaggaaaactaacaaacagaaaggacatccacaccaaaaccccaactgtacgtcaccatcatcaaagaccaaaggtagataaaaccacaaagatgggggaaaaacagagcagaaaaactggaaactctaaaaatcagagtgcctctcctcctccaaaggaagacagctcctcaccagcaatggaacaaagctggatggagaatgactttgatgagttgagagaaggcttcagacgatcaaactactctgagctaaaggaggaagttcgaacccatggcaaagaatttaaaaaccttgaaaaaaaattagacgaatggccaactagaataaccaatgcagagaagtccttaaaggaattctgatggagctgaaaaccaaggcatgagaactatgtgacaaatgcacaagcctcagtagccaattcgatcaactggaagaaagggtatcagtgatggaagatgaaatgaatgaaatgaagcgagaagagaagtttagagaaaaaagaataaaaacaaatgaacaaagcctccaagaaatatgggactatgtgaaaagaccaaatcttcgtctgattggtgtacctgaaagtgacagggagaatggaaccaaggtggaaaacactctgcaggatattatccaggagaacttccccaatctagcaaggcaggccaacattcaaattcaggaaatagaatgccacaaagatactcctcgagaagagtaactccaagacacataattgtcagattcaccaaagttgaaatcaaggaaaaaatgttaagggcagcaagagagaaaggtcgggttacccacaaagggaagcccatcagactaacagtggatctctcggcagaaactctacaagccagaagagagtgggggccaatattcaacattcttaaagaaaagagttttcaacccagaatttcatatccagccaaactaagcttcataagtgaaggagaaataaaatactttatagacaagcaaatgctgagagattttataaccaccaggcctgccctacaagaagagctcctgaaggaagcactaaacatggaaaggaacaattggtaccagccacttgaaaaacatgccaaattgtaaagaccatcgagactaggaagaaactgcatcaactaacaagcaaaataacagctaacatcataatgacaggatcaaattcacacataaccatattaaccttaaatgtaaatgggctaaatgctccaattaaaagacacagactggcaaattggataaagagtcaagacccatcagtgtgttgtattcaggaaacccatctcacatgcagagacacacatacgctcaaaataaagggatggaggaagatccaccaagcaaatggaaaacaaaaaaagtcaggggttgcaatcctagtctctgataaaacagactttaaaccaacaaagatcaaaagaggcaaagaaggccattacataatggtaaagggatcaattcaacaagaagagctaactatcctaaatatatatgcacccaaaacaggagcacccagattcataaagcaagtcctgagtgacctacaaagagacttagactcccacacaataataatgggagactttcacaccccactgtcaacattagacagaccaacaagacagaaagttaacaaggatttccaggaattgaactcagctctgcaccaagaggacctaatagacatctacagaactctccaccccaaatcaacagaatatacattcttctcagcaccacactgcacttattccaaaattgaccacatagttggaagtaaagcactcctcagcaaatgtaaaagaacagaaattataacaaactgtctctcagaccacagtgcaatcaaactagaactcaggattaagaaactcactcaaaaccactcaaatacttggaaactgaacaacctgctcctgaatgactactgggtacataacaaaatgaaggcagaaataaagatgttctttgaaaccaatgagaacaaagacacaacataccagaatctctgggacacattcaaagcagtgtgtagagggaaatttatgacactaaatgcccacaagagagagcaggaaagatctaaaactgacaccctaacatcacaattaaaagaactagagaagcaagagcaaacaaattcaaaagctagcagaaggcaagaaataactaagatcagaaaggaactgaaggaaatagagacataaaaaacccttcaaaaaatcaatgaatccaggagctggttttttgaaaagatcaacaaaactgatagactgctagcaagactaataaagaagcaaagagagaagaatcaaatagatgcaataaaaaatgataaaggggatatcaacaccgatcccacagaaatacaaactaccatcagagaatactagaaacacctctatgcaagtaaactagaaaatctagaagaaaggcataaattccttgacacctacaccctcccaagactaaaccaggaagaagttgaatcgctgaatagaccaaaaatgggctctgaaatagaggcaataattaatagcttaccaatcaaaaaaagtccaggaccagatggattcacagccaaattctaccagaggtacaaggagaagctggtaccattccttctgaaagcattccaatcaatagaaaaagagggaatcctccctaacccattttatgaggccagcatcatcctgataccaaaggctggcagagacactaccataaaagataattttagaccaatatccctgatgaacattggtgcagaaatcctcaataaaatactggcaaactgaatccagcagcacatcaaaaagcttatccaccatgatcaagtgggcttcatccctgggatgcaaggctggttcaacatatgcaaatcaataaacataatccagcatataaacataaccaacgacaaaaaccatatgattatctcaatggaggcagaaaaggcctttgacaaaattcaacaacccttcatgctagaaactctcaataaattaggtattgatgggatgtatctcaaaataataagagctatctatgacaaatgcacagccaatatcatactgaaggggcaaaaactggaagcattccctttgaaaactggcacaagacaggaatgccctctctcaccactcctattcaacatagtgttggaagttctggccagggcaatcaggcaggaaaaggaaataaatggtattcagttaggaaaagaggaagtcaaattgtccctgtttgcagatgacatgattgtatatctagaaaaccctattgtctcagcccaaaatctccttaagctgataagcaacttcagcaaagtttcagaatacaaaatcagtattcaaaaatcacaagcattcttatacaccaataacagacaaacagagagccaaatcatgagtgaactcccattcacaatagcttcaaaaagaataaaataccgaggaatccaacttacaatggacatgaaggacctcttcaaggagaactacaaaccactgctcaatgaaataaaagaggatacaaacaaatggaataacattccatgctcatggctaggaagaatcaatatcgagaaaatggccatactgcccaaggtaaattatagattcaatgccatccacatcaagctaccaatgactttcttcacagaattgggaaaaactactttaaagttcatatggaaccaaaaaagagcccacatcgccaagtcaatcctaaaccaaaagaacaaagctggaggcatcacgttacctgacttcaaattatactacaagcctacagtaaccaaaacagcatagtactggtaaaaaaaaacagagatatagacgaatggaacagaacagagggctcagaaataacaccacacatctacaaccatctgatctttgacaaacctgagaaaaacaagcaatggggaaaggattccctatttaataaatggtgctgggaaaactggctagccatgtgcagaaagctgaaactagatcctttccttacaccttatacaaaaattaattcaagatggattaaagacttaaatgttagatgtaaaaccataaaaaccctggaagaaaacctaggcaataccattcaggacataggcatgggcaaggacttcatgactaaaacaccaaaagcaatggcaacaaaagccaaaatagacaagtgggatctaattaatctaaagagcttctgcacagcaaaggaaactaccatcagagtgaacaggcaacctacagaacgggagaaaatttttgcaatctacccatctgacaaagggctaatatccagaatctacaaagaactcaaacaaatttacaagaaaaaaccaaacccatcaaagagtgggcaaaggatatgaacagacacttctcaaaagaagacatttatgcagccaaaagacacatgaaaagatgctcatcaccactggccatcagagaaatgcaagtcaaaaccacaatgggataccatctcacaccagttagaatggagatcattaaaaagtccagaaacaacaggtgctggagaggatgtggagaaataggaacacttttacactgttggtgggactgtaaactagttcaaccattgtggaagtcagtgtggagattcctcaaggatctagaactagaaataccatttgacccagccatcccattactgggtatatacccaaaggattataaatcatgctgctataaagacacatgcacacgtatgtttattgaggcactattcacaatagcaaggacttggaaccaagccaaatgtccaacaatggtagactgaattaagaaaatgtggcacatatacaccatggaatactatgcagccatgaaaaaggatgagttcatgtcctttgtagggacatggatgaagctagaaaccatcattctcagcaaactatcgcaaggacaaaaaaccaaacactgcgtgttctcactcataggtgggaattgaaccatgagaacacatggacacaggaaggggaacatcacacaccagggcctgttgtggggtggggggaggggggagggatagcatttggagacatacctaatgttaaatgacgagttactgggtgcagcacaccaatatggcacatgtatacatgtgtaactaacctgcacgttgtgcacatgtaccctaaaacttaaagtataataaaaagaaaatgaacatttaggttgtctgcagtggtttcactgttgaaactataaaactaaagcagccatgaacaagtacactattcttctgcacatgaatgagaattgttcccccttccatccatgcttaatttttctctttaatgttttttattttcagtacagtattaaatacattacatgagctattcaacactttattataaaataagctttgtgttagataatttcgcccaacagtaagctaatgttaagtgttctgagcacatttaaagtgttagcttacaaaattcttaaaacataaaaaagcacatagaacatagtgaaaatatttctagcaattccactatatcgatgtataatattctatctttcatatgtgcatagatataaatatagattttttataaaacaaaattatataagcttgctgttatataatgactttttgaaaactattaagatataactgacatataaaaaactatttataggacatatttaatgtatacaactacaatgagtttgaagacaagtatacacccatgtaatcatcatcacaatctaggccataaacatatccatcacctccaatagtttccactggcctttttacttattatttggtgtgtgtgtgtgtgcaataaaaataagacctatcatcttaacaaatttttaagtttgcaatacagtattgctaactaagggcactatgctatacaacaagtctctgagatgtatccatcttgtataactgaaattttgtgccctttgactaatatcttcaatctctctgcttgttattggtctgttcagggtatctaattcttcctgatttaagttaggagggttgtatttttccaggaatttatccatctcttctaggttttctagtgtatgtgtgtaaaggtgttcatagtagcgttacatgatcgtttgtatatctgtggtgtcagttgtaatatctcccatttcatttcttaatgagcttatttggattttctctcttattttctcggttaatcttgctaatggtatatcaattttatttatcttttcaaagaaccagctttttgtttcatttatcttttgtatttttttgtttcaatttcatttaattctgctctgatcttggttattttctttttttatcacactttaagttctggagtacatgtgcagaatgtgcaggtttgttatataggtatacacgtgccatggtgatttgctgtacccatcaacccgtcatctacattaggtatttctcctaatgctatccctcccccacatcccccgccgacaggcccaggtgtgtgatgcccacccccccgtccatgtgttctcattgttgaacttccacttatgagaacatgcagtgtttggttttctgtccttgtgttagtttgctgagaatgatggtttccagcttcatccatgtccctacaaaggacatgaactcatccctttttatgactgcatagtattccatggtgtatatgtgccacattttcttaatccagtctatcattgatggacatttgggttggttccaagtctttgctattgtaaatagtgctgcaataaacatacatgtgcatgtgtctttatagcagcatgatttataatcctttgggtgtatacccagtaatgggattgctgggacaaatgatatttctagttctagatccttgaggaatcaccacactgtcttccacaagggttgaactagtttacagtcccaccaacagtgtaaaagtgttccatttctccacatcctctctagcacctgttttttcctgactttttaatgattgccattctaactggcgtgagatggtatctcattgtggttttgatttgcatttctctaatgaccagtgatgacgagctttttttcatatgtttgttggctgcataaacgtcttcttctgagaagtgtctgttcatatccttcgcctactttttgatggggttgtttggtttttttcttgtaaatgtgtttaagttctttgtagattctggatattggccctttgtcagacggatagattgcaacatttttctccgattctgtaggttgcctgttcactctgatgacagtttcttttgctgtgcagaagctctttagtttaattagatcccatttgtcaattttggcttttgctgccattgcttttggtgttttagtcatgaagcctttgctcatccctatgtcctgaatggtactgtctaggttttcttctagggtttttatggttttaggtcttgtgtttaagtctttaatccatctcgagttgatttttgtataaggttaagaaaaggatccagtttcaacctcctgcatatggctggccagttttcccagcaccatttattaaatagggaatgctttccctattgcttgcttttttcagctttgtcaaagatcagatggttgtagatgtgtggtgttatttctaaggtttcttctgctgggtttggatttggttcttgtttctctagtcccttgagctgtgacattagcatgtcaatttgtgctctttcagtctttttgatgtaggcatttaggggtatgaactttcctgttagcactgcctttgctttatcccagaggttttgataggttgtgtcactattgttgttaagttcgaataattttttaatttccatcttgatttcatttttgacccaatgatcattcaggaacaggttatttaatttccatatatttgcatggttttgtagctgtttttggaattgatttccagttttattccactgtggtatgagagagtgcttgatataatttcaatttcctttttttgaaattttattttattattattatactttaagttttagggtacatgtgcacaatgtgcaggttagttacatatgtatacatgtgccatgctggtgtgcttcacccattcactcgtcatttagcattaggtatatctcccaatgctatccctcccgcctctccccaccccacaacagtccccagagtgtgatgttcccctttctgtgtccatgtgttctcattgttcaattcccacctatgagtgagaatacgcggtgtttggtttttttgttcttgtgatggtttactgagaatgatgatttccaatttcacccatgtccctacaaaggacatgaactcaccattttttatggctgcatagtattccatggtgtatatgtgccacattttcttaatccagtctatcattgttggacatttggctcggttccaagtctttgctattgtgaatagtgcctcaataaacatacgtgtgcatgtgtctttatagcagcatgacttatattcctttgggtatatacccagtaatgggatggctgggtcaaatggtatttctagttctagatccttgaggaatctccacactgacttccacaatggttgaactagtttacagtcccaccaacagtgtaaaagtgttcctatttctccacatcctctccagcacctattgtttcctgactttttaatgattgccattctaactggtgtgagatggtatcccattgtggttttgatttgcatttctctgatggccagtgatggtgagcattttttcatgtgttttttggctgcataaatgtcttcttttgagaagtgtctgttcatgtccttcacccacttttttatggggttgtttgtttttttcttgtaaatttgtttgagttctttatagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggcgttttagacatgaagtccttgcccacgcctatgtcctgaatggcaatgcctaggttttcttctagggtttttatggttttaggtataacgtttaagtctttaatccatcttgaattaatttttgtatacggtgtaaggaagggatccagtttcagctttctacatatggctagccagttttcccagcaccatttattaaatagggaatcctttccccattgcttgtttttctcaggtttgtcaaagatcagatagttgtagatatgcggcgttattactgagggctctgttctgttccattgatctatatctccgttttggtaccagtaccatgctgttttggttactgtagccttgtagtatagtttgaagtcaggtagtgtgatgcctccagctttgttcttttggcttaggattgtcttggtgatgcgggctcttttttggttccatatgaactttaaagtagtttttcccaattctgtgaagaaagtcattggtagcttgatgtggatggcattgaatctataaattaccttggacagtatggccattttcatgatattgattcttcctagccatgagcatggaatgttcttccatttgtttgtatcttcttttatttcattgagcagtgatttgtggttctccttgaagaggtccttcacgtcccttgtaagttggatacctaggtattttattctctttgaagcaattgtgaatgggagttcactcatgatttggctctctgtttgtctgttattggtgtataagaatgcttgtgatttttgaacattgattttgtatcctgaaactttgctgaagttgcttatcagcttaaggagattttgggctgagacaatggggttttctagatatgcaatcatgtcatctgcaaacagggacaatttgacttcgtcttttcctaattgaatacactttatttccttgtcctgcctaattgcccaggccagaacttccaacactatgttgagtaggagtggtgagagagggcatccctgtcttgtgccagttttcaaagggaatgcttccagtttttgcccattcaggatgatattggctgtgggtttgtcatagatagctcttattattttgagatacgtcccatcaatagcaaatttattaaaagtttttagcatgaagcgttgttgaatttttgtcaaaggccttttctgcatctattgagataatcatgtggtttttgtctttggttctgtttatgtgatggattacgtttattgatttgtgaatgttgaaccagccttgcattccagggatgaagccaacttgatcatggtggataagctttttgatgtgctgctggattcagtttgccagtgttttattgaggatttttgcagcaatgttcatcagggatattggtataaaattatcttttattgtagtgtctctgccagcctttggtatcaggatgatgctggcctcataaaatgagttagggaggattccctctttttctattgattggaataatttcagaaggaacggtaccagctcctctttgtacctctggtagaattcggctgtgaatctctctggtcctggactttttttggttggtaggctattaattattgcctcaatttcaaagcctgttattagtatattcagagattcaacttcttcctggtttagacttgggagggtgtatgtgtccaggaatttatccatttcttctacattttctagtttatttgcatagaggtgtttctagtattctctgatggtagtttgtatttctgtgggattggtggtgatagcccccctttatcattttttattgcatctatttgattcttctctctttttttctttatttgtcgcaatgctagtggtctatcaattttgttaatcttttcaaaaaaccagctcctggatttattgatttcttgaagtgtttttttgtgtctctaactctttcagttcttctctgatcttagttatttcttgccttctgctagcttttgaatttgtttgctcttgcttctctagttactttaattgtgatgttagggtgttgattttagaccttccctgctttctcttgtgggcatttagtgctataaatttccctctatgcactgcttaaaatgtgtcccagagattctggtacgctgtgtctttgttctgattggtttcaaagaacatctttatttctgccttcattttgttatttacctagtagtcattcaggagcaggttgttcagtttccatgtagttgagcggttttgagtgagtttcttaatcttgaattctaatttggttgcactgtggtctgagagacagtttgttgtgatttctgttcttttacatttgctgaggagtactttacttccaattatgtggtcaattttagaataagtgcgatgtggtgctgagaagaatgtatattgttgatttgggtggagagttttgtagatgtctattaggtctgcttggtgcagagctgagttcaagtcctggatatccttgttaaccctctgtctcgttgacctgtctaatattgacagtggggtgttaaagtctcccattattattgtgtgggagtctaagtctctttgcaggtctctaaggacttgctttatgaatctgggtgctcccgtattgggtgcatatatatttaagatagttagctcttcttgttgaattgatccctttaccattatgtaatggccttgtctcttttgatctttgttggtttaaagtctgttttatcagagactagaattgtgacccctgctttttttttgctttccatttgcttagtagatcggcctccatccctttattttgagcctatgtgtgtctgtgcacatgagatgggtctcctgattatagcacactgatgggtcttaactctttatccaatttgccagtctgcatcttttaattggggcatttagcccatttacatttaaggttaatattgtgtgtgaatttgatcctgtcattatgatgttagctggttattttgcccattaattgatgcagtttcttcatagccttcatggtctgtacaatttggcatgtttttgcagtggctggtacagattgtttccttctacgtttagtgcttccttcagggcccttgtaagacaggcctggtggtgacaaaatctctcagcatttcttgtctgtaaaggattttatttctccttcacttatgaagcttagtttggctggatatgagattctggattgaaaattcttttctttaagaatgttgattattggctcccactctcttctggcttgcagggtttctgcctagagatctgctgttagtctgatgggcttccctttgtgggtaacctgacccttctctctgggtgcccttaacattttttccttcatttcaactttagtgaatctaacaatttgtgtcttggggttgctcttctcgaggagtgtctttgtgatgttctcgtatttcctgaatttgaatgttggcctgccttgctaggttgcagaaattctcctggataacatcctaaagagtgttttccaacttggttccattcttctcatcactttcaggtacaccaatcaaatgtagctttggttttttcacatagtcccgtatttcttggaggctttgttcatttctttttactcttttttctctaaccttgtcttttcactttatttcattaatttgatcttcaatcactgataccctttcttccacttgatgcattggctattgaagcttgtgcatgcatcacgaagttctcgtgccatggttttcagctccatcaggtcatttaaggtcttctctacactgtttattctggttagccattcatctgactttttcttatggtttttagcttccttgcaatgggttcaaacatcctcctttagctcggagaagtttgttattatagaccttctgaagcctacttctgtcaactcatcaaagtcattctctgtccagctttgttccattgctgccgaggagctgcgatcatttggaggagaagaggcactctggtttttagaattttaagcttttctgctctggtttctccccatctttgtggttttatctacctttggtctttgatgttggtgacctacagatggggttttggtgtagatgtcctttttgttgacgttgatgctattcctttctgtttgttagttttccttctaatagtcaggtccctcagctgcaggtctgttggagtttgctggaggtccattctagaccctgtttgcctgggtgtcaccagcagaggctgcagaatagcaaatattgctgcctgatccttcctctggaagcttcgtcccagaggggcacttggccatatgaggtgtctgtcggcccctactgggaagtgactcccagttaggctacacaggggtcagggacccacttgaggaggtagtctgtctgttctcagagctcaaacaccatgctgggagaaccactgctctcttcagagctgtcagacggggacgtttaggtctgcaggagttgtctgttgccttttgtttagatatgccctgcccacagtggtggtgactatagaggcctaggccttgctgagctgcgatgggctctgcctaatttgagcttcccagccactttgtttacctactgaagcctcagcaatgatggacacccctccccccgccaggctgccacctcgcatttcgatctcagactgctgcactagcagtgagcaaggctccgtgggtgtgggacccgccaagccaggcccgggagagaatctctttgtctgccagttgctaagaccttgggaaaagcacagtatttgggtgggagtgtcctgattttccaggtaccatctgtcacggcttcccttggctagtaaagggaaatcccccaaccccttgcccttcccaggtgaggcgacaccccaccctgcttccgctcaccctccatgggttgcacccactgtccaaccagtcccagtgagatgaaccaggtaccacagttggaaatgcagaaatcacccaatcttctgcattgatcacgctgggagctgcagaccagagctgttcctattcggccatcttggagccgcctcctccatgagtatttcttatcaacctgagccttatcttacatgatcatactacagttatcaactttgttaaatttaaccttgatcaaacatacttttatctattctatcatgagtattaaattttatcacttcacccaataatgttctttttcttttatgaaattcaaattttggaagaatacagccaaccttttctttgaactgaatagtcttcaattggggtttatctgagattttcttaagattagatataagttatgtattctcaatgggaatagcatgtagatgatgctgtgtccttctcaggatatcatatatggaggcacacaatgtctatccatgttatctttctctgtctcagtttctccatttgaataacataaacaataatttattccatagagggatagtgttggcatgatgcaggggcatgatttgggcagggaacccatccaagcaagacaaaggtgaaagcttttacaggctcacacttccagccccaggaccctgacccccacctacctttgaagatgttggagttggaggtgctgaaacctatttgactggtggctcttcttccttgcctctaggaaccatggagcccctgcacagtgagtaggtggtgagcaaaaccagtcaattatgcagatcttagtcatgcttctggttgtggcagatctgtaagttctgtcccaaaccataagttgggtacatatagaacattgtccctgaattcctattcaaggagtactttcttctttttgctgcaggcaatatagatagagacagaacactgtggacctgcagaatcctctgctcccctaacacacacacaagtctggctgattgtggacactcagacacaagtctgggtgattgtggagtggaaggaggatctacatatctattttttttctaacattgtgtgaggaccttcataaagtctcatccatctttatattaatttctccattgctagcatcagcctaacaccaccttatcagcaatctcttgtgacttttgtgaggaaaagagagatctcttccaagagggcttcgaaaatatcacataacatgtagattttaaatatatagacttaaactatactcaaatcctacatcccacttactctaggaaagtcactaatcatctctgtgcctcaatttcctcatttttaaagtgagaatagcagtactttcttcataggatttttgggaggattccatgagttattttgtgttaaacactgagacccaatgtctggcatataagcagtgctatgtatggtttgctaaataaaccaataaaacacttattgaagtgttcagaatcacccagttggacaccaaattcactatgagtcaaatatttaacatgtattaaccaatactctcagtgacccagtgagtttagtgctaaatatttatattttgccaatgcagaaactgaagcatcgaggagctaagcaacttgcccaaggccacacagccaataagtggtagaaacaagatttgaaaggaagtgaattcagagccaggtatgccagatggtgaagcccacagcttttcctgggcctcagagccacgatacatcttgggcttattcccatcaccaaggcactctctctagatacccttacagtgctagcagaggggcataatgggaagggaaatttcaggagctgagctgactgtgagaggctctgagtaagtcttgactgggtctaggaatattcccagagttgtttggttgggatgagaaagtgggaaagtgggagagaagcaaagcctgtagattgtcctaacattttcttctctagttctatttccttgcctcttcccactttacaatatactcttggccttgtcctattcctgggacccctcatcaatttatatcatttacttctctccgtaggaaaaaaaaaagaaaaagatttcttttcaagatgtcattttttgctcttgtactaataaaagagcaactcatgcttagtgcataaattttgtaaaaatatgaaaatgacaattaaatttaaaaataattgttaatcttgtcaacctatgctaacatttgtgcatatattctagtagactttttcttatgtacatatatatttttatatagtggataatcctgtgactatttttaagtttaacatttacaataaatattttcctgtactcctaaatattttcaaaaatttcatagattggtagattactctgccaattaatcaccagttgttgacaagcttggtggtttcagtttttccctattgtagaaattcactattagttacataatgataactaaatccttgagtatttatttatttattccttgggaaagccaataaaagtagaaatacagataattcaatctgtgcataaatattaccaattctctcttcataatgtttaggctatacttgcaccaacaaagaaatggtctgaaaatgtcagaccatttccttcatcttgaccctgatatagacattcagaggattcagatggtaggtcggaggagccagcaggctattgactattcacagttgtctagtgtcacaatcacaggccttacactcatccgatgtaaacttaaaacccatctttacagaggcagatactaaaaaattaaaattaaaattaaaaaaccatctttatcatttgctaactccatgaccttgggtaactcatttcacttctggaaaactccattaaatcacatggaaaaattatagcacaggcatacctcatagatattacagattcagttccaggccaccctaataaagtgagtcaaacaaatattttggtttctcagtgcatataaaagatatgtttacactatactgtgatctactaagtgtgtgacagcattatgtataaaaacagtgtacatatcttaatccaaaaatagtttattgatagacatcaataccaagagctctcaaaaccacacacttacatgtgcttgttagtacatgctcctgttcctgaatgactttttggtaaacaacaaaattaagacagaaatcaagaagttttttgaaactaataagaacaaagatacaacataccaaaatctctgggacacaattaaaccagtgttgagaggaaagtttatagcactaaatgcccacatcaaaaagttagaaatatctccaattaacctaacatcacacctagaggaacttgaaaaacaagagcaaaccaaccccaaagctagtagaagaaaagaaataaccaaaattagagctgaactgaacaaaatggagataagggaaaccatacaaaagatccatgaaaccaaaagttggttctttgtagaataaataagactggtagaccactagttagactactaaagaaagagaaaatccagataaacacaatcaaaaataacaaaggggatattaccactgaccccataaaaatacaaacaaaaatcagagactattacaaacaccactatgcacacaaactagaaaacctacacaaaattgataacctcttggaatcatacaaactcccaagattaaaccaggatgaaattgaacagaccaataacaagtaccaaaatttaatcagtaattaaaaaaaaacttaccaaccagaaaaggccctggaccagatggattcacagccaaattctaccagacatataaagaagagctggtgccaatcctactgaaattattccaaaaacttgaggaggagggactcctccctaattcattctatgaagtcagcatcattctgacatcaaaacctggcagagagacaacagaaaaagaaaacttcagaccaatatcactgatgaacatagatgcaaaaatcctaaacaaaatactagcaaaccaaatccagcagtatatcaaaaagctaatccaccacattgtttcctgttgggagctccctgcaatacccaccccccctcccccctgccccgcaaaaaaatgaattcaccacaatcaagtaggctttatccctgggaagcaagattgattcaacatatgcaaatcaatacatgtgattcatcacataaaccaaactttaaaaaaagatcatcttaatagatgcagaagaggcttttgataaaatttaacatcttttcatgttaaaaaccctcaacaaaccagacatcaaaggtacataccacaaaatagtaacagtcaactctgacaatcccacagccaacatcataatgaattgacaaaagctggaagcgttcctcttgagaagcggaacaagacaaggatgcccactcttgccactcctactcaatatagtattgaagtcctagccagagcaatcatgcatgagaaagaaataaaagtcatctaaataggaagagaggaagtcaaactatgtttgacagacaatattcacagacaatataagcctagaaaaccctgtagtctctgcccaaagcttctagatctgataaaccacttcagcaaaggttcaagatacaaaatcaatgtacaaaaatcagcatttctagcagcatttcaatcgtatgaaatgcatagaaatatgtccaagctgagagtcaaatcaagaatgcaatcccactcacaatagccacaataagaataaaatacctaggaatacagctaaacagggaggtgaaagagctttacaatgagaattataaaacactgtatcagagacaacacaaacaaacagaaaaacattctatgctcatggataggaagggtcaatattgttaaaatagtcatactgcccaaaacaatttacggattcaatgttattcctatatacaaactaccaacatttttcacagaatcagaaaaagccatttgaaaatgcatttggaagcaaaaagggcctggatagccaaaacaattctaagcaaaaagaccaaagctggaggcattatacttccagacttcaaactatactacaagcctacagtaaccaaaacagcatggtactggtacaaaatgagaatcattaacaaatgaaacagaatagagaacccagaaataaagctacacacctacaactgtctgatcttcaatgaagctgacaaaaacaatcaatgggaaaaggacttcctattcaataaatgctactggcataactggctaaccatatgcagaagaatgaaactggacccccactttttaccacatacaaaaatcaatacaagatggattaaagacttaaatgtaaaatctaaagctataaagaccctagaagaaaatctagaaaataccattctggacattggcccaggcaaagacttcatgataaaaactctacaagcaattgcaaccaaaacaaaaattgacaagtgggacctaattaaactaaagagcttctacactggaaaagaaactatcaacagagtaaaagacaacctacagaatgggaacaaatatttgcaaactatgcatccaacaaagatctaatatccagaatctataaagaacttaaatcaacaagcaaaaaacaaaaaaaaattttaatgggtaaaggacatgaacagacccttctcaaaagaagacataatgtggccaaaaagcatatgataaaaatgctcagtatcactaatcattagggaaatgcaattcaaaaccacaatgagatattatctcacaccagtcagaatggctggtgagggagaaaagggaatgcttgtgcagagctggtggtgtaaattatttcagccactgtgaaaagcagtctggagatttctcagagaacttaaaatagaactaccatttgacccagcaattccattactaagtatatatccaagagaatagaaattgttctaccataaagacatatgcctgcgtatgttcatcacagcactgttcacaatagcaaagacatggaatcaacctagggtgcccatcaatggtggactcgataaagaacatgtggtatgtatacaccatgaaatactacctatttttaaaaatgagatcatggcctttgcagcaacatggatggagctggaggccattatcctaagcaaattaagcaggaacagaaaaccaaataccacacattctcacataagtgtgagctaaccattgagtacacacgggcacaaagaagggaacactagacactgggacctattttagggtggaagttggtatgagagtcggattgaaaaactacctatcatggattatgcttattacctggatggcaaaattatctgtacaccaaactcccacaacacacaatttatccatctaacaaacctgcacatgtactccttgaacctaaaagttggcaaggcaaaaaaaaagaagaaaaatactttattgctcaaaatgttaacatcatctgaaccttcagcaagtcaaaatcttcttgttagtggaaggccttgcctcagtgttgatggctgctgactcatcagggtggtggctgctgaaagttagggtagctgcagaaatttcttaaaataagacaatgaagtttgccacattgattgattgcccttcacaaacaattgtgcagtagcatgcaatgttgtttgatagcattttgcccacagtagaacttctttcaaaattagagtcaatcctctcaaatcctctcataaggatttgataaagttgataaagttgataaagttgatagctttatcaactaagtttatgtgacattctaaatcatttgttgtcatttcaacaattcattttcttcctcagcatgcttactaggagaagtttccatctcaataaaccacattctttgctcatccattcaggttttatcatgagattccaggaattcaatcacatctttgggctcaactttagttctcttgttatttccaccacagctgaggttacttactccactgaggtcttacacccttaaaagtgattcatgagagttggaatcaatttctccaaaacttcttttagtgttgatattttgacctcctcctgccaatcatgaatgttcatctagaatggtgaattatttccagaaggttttcaacttactttgccaagatccatcagcgaaatcactatctatggcatctatggccttataaaatgtattttttaaacaataagacttgaaagtcaaaattgtcccttgctctaggagctgaagaatggatgttgtgttagcgagcatgaaaacaacactaatcttgtacatctccatcagagctcatgaatgaccaggcacattgtcaacgtgcagtaatattttgaaaggcaacttcttttctgagcagtaggtctcgaacacggatttaatataaatcatcatgtaaatagatgtgctatcatccaggcttggttgtttcatttatagagtgcaggcagaatatattttgtacaattctgaagggcctgcggattttcagaatggtagatgagcattggcttcaacttaaggtcaccagctgcaccagcccctaacaaaagagctgtcctgtgctctctagctatgaagtcctagatggcatcttcttccaacagaaggctgcttcctccacattgaacatctgttgtttagcgtagacaccttcatcgcttatcttaactagatcttctgggtaacttgctgcagtttctacatcattgcttgctgcttcaccttgctcttttattttatggggatggcttctttcttaacctcatgaaccaaccactgctaacttttcttctgcagcttcctcacctctcagcctcaatagaattgaagagggttatagtctttctctggattaggctttatcttaagagaatattgtggatggtttgacgttctattcagaccactaaaactttcttcatatcagcaaaaggctgtttttcctcttatcattcatgtgttcactggagtcgcccttttgatttcattcaagaactttttctttgcattcccaacttggctaactgatgcaagtgacctagttttcagcctgtctcagctttcgacatgccttcctcactaagctttatcattcctagcttttgatttaaagtgagagatgtgtgactcttcctttcatttgaacacttggagaccattgcggggttattaattggtctaatttcaatattgttgtgtctcagagaatacgaaggcccaagaagagggagagggatagggaaagagctggtcagtgaagcagtcagaacacacatatttatcaattaagctcatcatcttataagggcacagtgcccccaaacaattacaatcaaggatcactgatcataggtcataataacagatacaataatcatgaaaatgtttgaaatattatgaaaattaccaaaatgtgacacagagccactaaatgatcacatgcttttcaaataatgacactgaaggctgggcgccgtggctcatgcctgtgatcccagcgctttgggaggccgaggcgggcggatcatgaggtcaggagatcgagaccatcctggctaacacggttaaaccccatctctactaaaaatacaaaaatttagccgggtgtggtagcgagcacctgtagtcccagctactcaggaggctgaggcaagagaatggcatgaacccgggaggcggagcttgcagtgagacgagattgtgccactgcactccagcctgggcgacagagcaagactccgtctaaaaaaaataaaaaataaaaaaaaatagcactgataaacttgttcaagtcagggttgccacaaatcttcaatttgcacctgcaatatctaagaggcacaataaaatgaggtatgcctgtaataatagagtatatctcattgcctaatattataattaagtgagctaaatgatgtggttttttaacatcgtctcaagtagatttattgtcagtaattaatggtaatagtacacaaagtggagaacaaaggaaccgtgcaattaaaactttaatttttagtaaattttaaaatttactaaacttttgagtaattttgtgttgtaccaactttttttgccagtgtgttcaatccaattccttctttaaattttatttttaattgacaaataataatggtatatatttatgaggtacaaggtgatgttttgacatgtttacattgtgaattattaaatcaagctaattaacaaatctatcacctgacatagttatcttttgtaatgtggtaaaaatatttaaaatctactcttttagtaattttaaaatacataatgtgttactatttatcataatcaccattctgtgaaatagacccctaaagtttatttcttctgtctaatcaaaactttgtatcctttcatcaacagattccctttcctggttcaccccctcctccagcttctggtaactaccattccactctctacttctgtgagttggactttaattttagagtccacatataagtgaggttatgcattatttgcctttctgtgccaggcttatttcacttatcataatgttctccaggttcatccatgttgtgacaaataacagaatttccttttttaaggctaaatagtagtccactgtttatatataccacattttaatccatttatctgatgatgaatacctaggttgattccatatcttggctattgtgaataatgctacagtgaacattggagtgcagatatgttttgacatgctgacttcaatgtctttggacatatactcagaagtgggattgctggaacatatgataattctagttttcattttctgaggaccctccatgctgttttccaaaatggctgaaccaatctacattcccaccaacagtgtgcaaggattcccttttctccacatacttgccaacatttatctttcatactgttgataatagccaatctaccaggcgtgaagtaatatttcattgtggtttttattcgcatttctctgatgattaaaaatgttgatctgagctttgtcagcaacaagtaaaaataaataaataagaaatgttgagcattttttcatatatctgttggacatttgtatgtcttcttttgagaaatgtctactcaggtcctctgcccattttttaaatagggttgttttcttgttttgagtagtttgagtttcttacatattttggatattggctccttatctgatttatcatccaaatagtttctcccaatatgtgggttatgtcttcactgtgttgtttcctttgctgggcagaaggcttttagtttaatacaatattattcccctatttttgcttttgttgcttgtgctttgggagatcatatccaataaatcactgccaagaccaatgtcatgaagctttcccactatgttttcttctagtagtttttacggtttcatgtcttacatttaagtctatgattcattttgagttcattctagtataagaggtaagataagggtccactttcattcttctgcatatagatatagttttgcccacaccaattattgaaggtactgtcctttccccattgtgtgttctttgggcccttgttgaaaatcaattgaccataaacgtatgggcttatttctgaaatctctaacctattccatcagttgctgtgtctgtttttatgccaatagcatgctgtttttattactatacctttgtaatacattttgaaatccagcagtgtgatacctctatctttttctttttggtaaatttgtctttggctattctgggtttccagtggttccatgtgaagcttcagattatttctttctgtttctgtgaagaatgacattagaatgttaatatggattgcattgaatctgtacatcactttggatagtatggacattttgccaattttgattcttccagtccgtgaacataggatagctgtctgtaagttcttctagtaaaaacacactttactgacaaactggatttctctggttgtttttttggtttcttggctccttcagcatttgggggacactttgcacatatggccctcacatgaaacagtccttttagcattttttataagacaagcttagtgttggtgaattctctcagcttttgcttgtttgggaaagtctctaatctctccttcatgtttgaagggtagatttttgagggttagcaggtttttccttcagcactttgaatataacatctcactgtcatctggtcatcagggtttctatgaaagccatattgaggcttcatctaatgtaatatgtttcttttttcttgctactttgagtattctttctgtctttgatttttgataattttattattatatgccttgtggatttcctgtttgggttgaatttcattggtgacttctgagcttcctgcacctggatgctgtcatctttctccagatttgggaaattttcagccattatttctttaaatatgctttgtgggccctttctctcttgtcttctctaggaattctaattatgcagaggttaatttgcctgatgatgtcccatagttcttgtagaccttcttcattcttttttttctctttttgttcctctgattggtgatttcaaatgttctgtcttcaagcttgctaattcctctgtttgctcaagtctgctgttgaagctttataatgagtttttcagttcaattattttattctttattactagtatttctatttctattgcttggttttttttttcattgtttctataaatcttcaattcttctgggaccattcctggagctttgttgatttcttttgatggtattgaatatttctgagttttcacaagccttgtatctttacatggatgcctgcatatttgaggcgactgccaactcttccagcttttgcaggtgctctttcatggtgttagacctttacttcttagtattagaacttaaacactggcctgttgttgctttacactgtagagagggcttaatagtgagcatcagaactaaaacattgcactggacctaactcattgccctgtcattgtttcccagtgtaaggaaaacttatagtgagcaccacagcttaaatgccctggaacaatattgctgccctactattgtttctcagtgtgggaaaaacttaggtgggtactgaaaatcttgaccttttagttgtttctgggccagggaaaagcttcacatgtgcacctgggctttgtggatttgggccttcccataaattttgtcccctacaatactctggcccccccaccagtctcttcaatatggcatccccactgatcaaagcactgaacaatcaccaagatccacatgccagttgctgcaatcagtgacctactctttgtccccaattcaccccaggtttttcagccctcttggttctctagtgggatgaaactggagtggacttaccattaagattcctagacaagtgggaagatcaaatatccacctccaattccttcttctcatctcagcaactgtgggtctagggaagttctctgtgagtggtattattatggcctgggagagagggtggaacaggctgaaatgaccatttctcttacctgtcactgcttctctcaattctatgagcccagggggtttctctgcttctcaagttctggtgtattcagggtggcattcttgtctttgaatagtttttcattttatttttgtgtcaggaagtgatcccaggagatctattctgccatcttgctgacatcacttcccagtttagtcctgaggtatcagggatggattaagaagcacatggctttccccatcctgggaaaattctccaggacagggcaaaccagctcttgcaccagagacatatccacagagtagcctttcttgtattgtcactctctgcagctcatatccttgtgctgggctgtgaggcaggcactaaggacactctttaggtaacagtggaacgcagaacaaagagaagtcaagctagcctcagagaagagaaaatttgtcttaagtttttgatatcacaatctgcatctttttataatttgtatcccttgacaaattattgtaggtttcattgtttttaatagctttgccttttaatgttattaaagatataatttatttacccactgacattacagtatcagagtattttggatttcacaatgtatttacttttatcagtgaatgttatactttcatatgttttccagtcactaattagtgtcctcttcttcagcttgaagaactctctttagcacttcttgtaaggcaagtctagtagtaataaactctctcagcttctgtttgtctgagaaagtctttatcaccccttcatttttgaaagaaaagatttctgggtatagtattcttggttgacagggttgttttattcaggatttttaatataacatcccacccccttctggcctacaaagtttctgctgagaaatctgctgataatctaagggagggttctcttgtgtgtagcaattcactatttcctcactgtttttaaaactttctctgtctttttgcatgtatggcagggggagggtggtgagtattctggtttcttccatcctatggtgaaggtgaatgccagtatttatctctccctctctctgcactaagctggagagataatctgtgacaaatgcctatacttgtgtccaaactgcaccctctgatcctggtgagatagctgcttgatatggttagaatctgtgtccccatccaaatctcatgtcaagttgtaatccccaatgttggcggtggacctggtgagaggtgattggatcacgggggtaaatccttcatgaatggtttaacatcatctctttggtgctgttctcatgatagtgagtgagatgtggttgtttaaaagtatatagtacatccctcaccccgctcctcctccagccatgtgaagatgcctgctctggctttgtcttctgccatgagtaaaagctcctgaggcctcctcagaagcagatagtgccatgcttcctgtatagcccatagaaccatgagccaattaaacctcttttctttataaattatgcaatcttgagtatttatttatagcaatgagagaatggactaatacatgctgaaagtgggcccgttgtatgcccatgtctttgttttctgtagtcccaggccgcttaggaatgcaaagtctcattgggaatgcaaagccccattagtccccagagctaggttgataaggagacagtcccttgggtggaaactatagaagcttaggtactcagtacacggacaaactccttccaggaagaatgggtcgactggatttatcactgggatgagccaaaggaaaggctcagaaagtgctcagctcaagctcaggatgacagggagctactttctccccttaggtcctcaatgcaaattcattaaaagcaaggtcatcaagtagccaccaatagagtaagcaggaaaccccttgcaaagagaaaatgggagctcagcattctagtcccttttctacactgctcccaggagatgtagaccctggcagtgttattatgtccatttaaaaccacctttttggctgggtgcaatggctcagcctgtaatcccagtactttgggaggctgaagtgggtgggtcacttgaggtcaggagttcaagaccagcctggccaacatggtgaaacgctgtctccactaaaaatacagaacattagccagatgtggtggtgcatgcctgtagtcccagctacttgggaggctgagacaggagaaccgcttgaacccgggaggtggaggttgcagtgagccaagattatgccattgcactccagtctgggtggcagagtgagactctgtttaaaaaacaaacaaacaaacaaaaaaacctttttgtatgtgatctgggaagacttgagtatgcatagtttcaggtggtagctgctgtaaaagttgggccactcaatgcatggcataaaccccttacagggagtaacagggagctgcatttttaagccccttttctgtaccactccaagagtttgaaacccccagaaatacgtgtgcacctgtataaacctaccactcttgtctgttgtctagagagattctcatatgcatagtcctctctgctcctaaagctgggagttttagagtgcagtccttccagtagaagctgcaaaagttgaggcattctacatgtggacaaactctctccaggaaggagtaatagacctggagttatcactggagtgagccaggggaaaaggcttaggaagtgttgatctgcttctgaggctaccagcaggctactatttgcctctttaactccccaatgcaagttaattaatgcaagttaattagaagcccagccaccaagtagcccctagaagagtgtcataaacccctcccagagaaaaacaagaagctgcatttttttaagtccttctctgcactgcctccagagagtgaggcccctggaagtgcttgttctgtagcataaaaccactgcttttttcctgtaggtcagaaagactcatgtattcctaatcccctccacttccagagttgattaattgagccgaaccacggggaatttcagagctaaagcactatatgtgaggcccaaaccctcctctccacagagagaagttgtgtgttagggattcctttcctggttgtatggcacagtgtccaaggtggagttcatgcctgagtgcacctcagcttttcccactcatttgatgcagatgttttttctcagttgcccagtgggtaggagtctctcaattggttcctgacttttttcagagaatcaatcagtgaatagtttgttcagtgcattggtgggtgaagggagagtcaggagtctcctatttcaccatgttgctgatgtcatctaagggtaagcctttaggcttggcaacaatgacttctggataggagacttcccttgaatctttcacagcatgaacattctatttttgtgccaacatgcatttcacggtgaaagaagtcacaacaggggcctcagacaccaaacgcaaccttagatttcaaataacgtcctgtagttcatgaattaggtatcctgagtttggaataatgcagactgctaacagaggtaggggagggacaaacattgctggtgacgacattggtatagaaccacctgtgagcatcaaatgcagccaaagtacagaaacaaggtaggggtggatcagtgtcatgttgcatacatgagatggcagtatccttctagagtctccccatttacattcacttcgaaaagcagcatggcctaggagatagaaaaagaacaaacaatgcaaaagcaatggcaaccataagactatgtgtttgctctcaaacacaacaggcctcatctgtgattcttttcaggctagaacttgacattttggagatccagattttggaagaatttgcctttgcttcttcctctgcctccaagacgtccatgttcttctaagggtcctcactaccttactctacataatatgagagcacatagatgttttcatagaagagagagcacacagtcataaccaaatgggcactcctttcagctttgagttccctggggcactgtgagctgtccagagagctctctggaacacaggtcagggcaccagtgattagaagaaagcagagcaactgcttccagtaaaattcatagtctatgatgctcatgccagtgacatggaataggtcaacctgacacccatggcatgtccacatggtacagtgcactgaacttgaatgggggaggttattctctatatggtccctgaaaggtaaatttgcctctcttaatagtgtctcctagcagtgtttggagatggcctgagatgacgcttgctaagggaggctatctgaggaagcaccaaataagatctcttagagaccatgcccttatagcccacctactgctgatgatgtctgtgttggtagttgattatgatctcttttctaagactcccttgtccaagaaaagctcttgagaaaggtgaagacaaatctgagatatccagagcctggtgtgatgcctcagaggtggctcatggcctctggtctgatgggggaagttttcttctctgatgtctctttcattgaatagcccagcaagaagcactagactggagcataacactgcacacctgcctctgggcatggcctgtcctcctgaaacctcttcacatttgactccgtgttccaattagccacatgtgatgcaaccctggatctggccccaggatcatttcagaggagttgcgattgcatagagtaagggagagtctgtaccacagtggttaatttccactaactcacagtaggatgacaggcaagacccactgccactctgtgccaattactccttagcaatagcagcatgaaccacctgttccccaccccttggtgttcctcttgatcaaaagaaaagagaataagcctctaaggaagagggcttgggaaagatagggactattcagttaatggaaggtgctggagtgttagatcctgagacccaaattgggtcccatcagaggagtagccatgttggtgggtgctggataggaggagctttggggttggtgcaggcactcactctcactaggatgcctctggtctcaagtaatggagagaagtgagaaaaagtgagctcagaggaaacatcctcttccggccacatcatatcctctctctctcttgtggccttaggcatgtcgctggccttcctgggactcattatcctcattgtaaagagacagcaatctgaagctcagaaagagattggggagcatgaggtgggggagtaccaaggctaaggagaccaaagcagtgcttgggggcctcccactctttaccttgggttctaactgccacccatctcgtgcttaatgggtccttctgactccagggtgagaaatgttctccttagcatcaggagacgctgcacatgagcagttcctccccctgggagtactggttcagtgagcaaaacagcaaggggctgggcatcctgagggctgggagggatacatgggccaaagaaggagaaggagggtagagaagcatagccagggagagaaatcaaacaccaggacacaagatgagtggggcatctttgggggctacagtgggctctcaatgatcacctgtagtggcagcaaaagaggcaggatccatgggcatttgttctggtttatttgacagggacagggagttcagacactggggagggtggcattcctgttgatgttcttgtgctgatgatttgatgtccttgtgcttcggatgtgggcacagtctcggatggaagggttcagggagcaggatgcacatcccagcccactctcccactcataggatgctcatacaaatgttcccacagaaggctgaacagcatatcttatttgtttcacacttttggaaatatgaacagtggtggatgcatagatctatgctgggtcgcttctcacagaccttgattcctgaaatgatgcaggagcagggtcaatgaaaccatgcacctatagagcagccttctcaagcttgaagctcctccatggccccagaaccaaggcacccctgccaccacgactctcctggactcttcagggaacttccttccagcccatcaccaatcctagtgattggcagtatcttaaatcctgtctccctgccctgcatctcaccccagtagacttcaatgcctgggcttcctggactctcgccatacacctgcattcagaactctgtctccccattaatcatggtgaagtcacccccatagaatctatggtctgaccctgagagctcaaagaagcctgagacatttccaaaccctcccctagtctccagaatttgcagagcccagaaaagaagatgaacttgcctctcatccctccttctcctctcctctccatcactgtccctagtatcgcttcccaccaccactctcctggctcctttgatgttatacttaactttgccctgtatactccaacttttcattgcttatgtcctttttaccctacacttatacccatttctacacctacacctaccctcataaccacttctagatgttcactcctcacaaatgtgcataaatcaaagaataattgtcttgctttcccattggattctcagccctggttcacctttcactatgggatgtaccatttgtctctaagtactgggagcaaacaacaaaagatgtaggttcccccttcattcccactactattcccagggccaggtaaaggggttggagggccatggtttgggacagcccagagtctgcacagcattgtggtcagagctggatatgcagaaaggttgcaagtcctaggtcctactcagactggacacagctcctccattccccctacccaactctccatcacccatccagcagcccatcacctactctgcatcctcatcttgtcacggtatcctccctgggcctgcagcagcagcacacagagaaccaggacaagcagcagagtctggggtgccataactctgaccagagcgtgagccctaagtctggccaggcagtcacagacttccctgcagagctgcctgtggagagggaaggaaataaagaaggaatgatcttcagctcctcgctgcctccactggacaagtcagggcagagcaagagtccttgcttcctgcccttgccttctcctggccctgtccttctccatgtaggatagggcttctgcaggaatgatgcctcctctcacatcacataaccagtcctgtgttcttgctaacagagtttttcttttccaaaaggtactctttatttctgctttctaattataaaatgctttatggaaaaaagaaaagaagaaatataattttttaaaaggtgcttagaattaacccatattttattacattatcttttagttcctctgtatatttaatgtaaacaatcttttattttctcatttttgaatcacctatcttttgttacctaccgtctgccacctttatttagtcatgcaaatatttacaatgtcattatttctcaaaaagaaaagacataatttttttgggggggggcggtgaacgtagctacagatagacactccaatttccacagttgtgaaagcagaaatcatatcatgagcccctttaggaagtggctatttgcatataatggatgtgttcattataaattcttctttttttttttttagacagagtctcactccacaccaggctggagtgcaatggcgtgatcttggctcactgcaacctccaccttccaggttcaagcaattcgcacctcagcctcctgagtagctgggattacaagcatgtgccatcacacccagataattgttgtatttttagtagagatggggttccgccatgttggccaggctggtcttgaactcctgacttcaattgatccacctgtatcaacctcccaaagtcatgggattacaggcgtgagccaccacactcggcctaattataaattattcttatcaattcattacacaaaactctatatgattgagctatatttttaatattaagttctggggtacatgtgcaggatgtgcaggtttgttgcatgtgctgtgggggcttgctgcacctatcaacccatcacctaggtatcaagcccagcatgcattagccatttatcctgatgctctccctcctatgacaggccccaaggtgtgttgtttacctccctgtgtccatgtattctcattgttcagctcccacttataagggagaacatggggtgtttgaacatggggtgtttggttttctgttcctccattagtttgctgaggataacggcttgtagttccatccatgtccttgcaaagaacatgatctcattcctttttatgccacatagtattccatggtgtatatgtaccatattttctttatccaatctatcattgatgggcttttgggttaatttcatgtctttgctattgtgaatagtgctgcaatgaacatatgcatgcatgtgtctttataacagaatgattccattcctttgggtatatacccagtaatggggttgctgggtcaaatggtatttctggttctaaatctttgaggaatcatcacattgtcttccacaatggttgaactaatttacattcctaccaacagcatgaaagcgttcctatttctccacaacctcaacagcatctgtagtttcttgactttttaataacctccattgtaactggcgtaagatggtatctcatcgtggttttgatttgcattactctgatgttcagctttttttcatgtttatcggctgcatatatgtcttctcttgagaagtgtctgttcatgtcctttgcccactttttaatgggattgcttgtcttttcttttattattattattattattattattattatactttaagttttagggtacatgtgcacaatgtgcaggttagttacatatgtatacatgtgacatgctggtgcgctgcacccactaactcatcatctagcattaggtatatctcccaatgctatccctcccccctccccccaccccacaacagtccccagagtgtgatgttccccttcctgtgtccatgtgttctcattgttcaattcccacctatgagtgagaatatgcggtgtttggttttttgttcttgcgatagtttactgagaatgatgatttccaacttcatccatgtccctgcaaaggacatgaactcatcattttttatggctgcatagtattccatggtgtatatgtgccacattttcttaatccagtctatcattgttggacatttgggttggttccaagtctttgctattgtgaatactgccgcaataaacatacatgtgcatgtgtctttatagcagcattatttatagtcctttgggtgtatacccagtaatgggatggctgggtcaaatggtatttctagttctagatccctgaggaatcgccactcccaccaacagtgtaaaagtgttcctatttctccacatcctctccagcacctgttgtttcttgactttttaattattgccattctaactggtgtgagatgatatcccattgtggttttgatttgcatttctctgatggccagtgatggtgagcattttttcatgtgttttttggctgcataaatgtcttcttttgagaagtgtctgttcatgtccttcgcccactttttgatggggttgtttgttttttccttgtaaatttgttagagttcattgtagattctggatattagccctttgtcagatgagtaggttgcgaaaattttctcccattttatgggttgcctgttctctgatggtagtttcttttgctatgcagaagctctttagtttaattagatcccatttgtcaattttggcttttgtttccattgcttttggtgttttagacatgaagtccttgcccatgcctatgtcctgaatggtaatgcctaggttttcttctagggtttttatggttttaggtataacgtttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttatttctgagggctctgttctgttccattgatctatatctctgttttggtaccagtaccatgctgttttggttactgtagccttggagtatagtctgaagtcaggtagtgtgatgcctccagctttgttcttttggcttaggattgacttggcgatgtgggctcttttttggttccatatgaactttaaagtagttttttccaattctgtgaagaaagtcattggtagcttgatggggatggcattgaatctataaattaccttgggcagtatggccattttcatgatattgattcttcctagccatgagcatggaatgttcttccatttgtttgtatcctcttttatttcattgagcagtggtttgtagttctccttgaagaggtccttcacgtcccttttaagttggattcctaggtattttattctctttgaagcaaatgtgaatgggagttcactcatgatttggctctctgtttgtctgttattggtgtataagaatgcttgtgatttttgaacattgattttctatcctgagactttgctgaagttgcttatcaacttaaggagattttgggctgagacaatggggttttctagatatgcaatcatgtcatctgcaaacagggacaatttgacttcctcttttcctaattgaatacactttatttccttctcctgcctaattgcccaggccagaacttccaacactatgttgaataggagtggtgagagagggcatccctgtcttgtgccagttttcaaagggaatgcttccagtttttgcccattcagtatgatgttggctgtgggtttgtcatagatagctcttattattttgagatacgtcccatcaatacctaatttattgagagtttttagcatgaaggttgttgaattttgtcaaaggccttttctgcatctattgagataatcaggtggttttgtctttggttctgtttatatgctggattacatttattgatttgcgtatattgaaccagccttgcatcccagggatgaagcccacttgatcatggtggataagctttttgatgtgctgctggattcggtttgctagtattttattgaggatttttgcatcaatgttcatcaaggatattggtctaaaattctcttttttggttgtgtctctgcccggctttggtatcaggatgatgctggtctcataaaatgagttagggaggattccctctttttctattggttggaatagtttcagaaggaatggtaccagttcctccttgtacctctggtagaattcggctgtgaatccatctggtcctggactctttttggttggtaagctattgattattgccacaatttcagctcctgttattggtctattcagagattcaacttcttcctggtttagtcttgggagagtgtacgtgtcgaggaatttatccatttcttctagattttctagtttattttcgtagaggtgtttgtagtattatctgatggtagtttgtatttctgtgggatcggtggtgatacccctttatcattttttattgcatctatttgattcttctctctttttttattagtcttgctagtggtctatcaattttgttgatcctttcaaaaaaccagctcctagattcattaaatttttgaagggttttttgtgtctctatttccttcagttctgctccgattttagttatttcttgctttctgctagcttttgaatgtgtttgctcttgcttttctagttcttttaattgtgatgttagggtgtcaattttggatctttcctgctttctcttgtgggcatttagtgtcataaatttccctctacacactgctttgaatgtgtcccagaggttctagtatgttgtgtctttgttctgattggtttcaaagaacatctttatttctgccttcatttcgttatgtacccagtagtcattcaggagcaggttgttcagtttccatgtagttgagcggttttgagtgagtttcttaatgctgagttctagtttgattgcactgtgatctgagagatagtttgttataatttctgttcttttacatttgctaaggagagctttacctccaactatgtggtcaattttggaataggtgtgttgtggtgctgaaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggcgcatatatatttaggatagttagctcttcttgttgaattgatccctttaccattatgtaatggccttctttgtctcttttgatctttgttggtttaaagtctgttttatcagagactaggattgcaacccctgcctttttttattttccatttgcttggtagatcttcctccacccttttattttgagcctatgtgtgtctctgcatgtgagatgggtgtcctgaatacaacacactgatgggtcttgactctttatccaatttgccagtctgtgtcttttaattggagcatttagtccattacatttaaagttagtattgttatgtgtgaatttgaacctgtcattatgatgttagctggttattttgcttgttagttgatgcagtttcttcttagtctccatggtctttacattttgacatgattttgcagtggctggtaacggttgttcctttccatgtttagtgcttccttcaggagctcttttagggcaggcctggtggtgacaaaatctctcagtatttgcttgtctataaagtattttatttctccttcacttatgaagcttagtttggctggatatgaaattctgggttgaaactctttcctttaaggatgttgaatattggtccccactctcttctggcttgtagagtttctgccgagagatccactgttagtctgatgggcttccctttgtgggtaacccgacctttctctctggctgcccttaacattttttccttgatttcaactttggtgaatctgacaattatgtgtcttggagttgctcttctcgaggagtatctttgtggcattctctgtatttcctgaatctgaatgttggcctgccttgctagattggggaagttctcctggataataacctgcagagtgttttccaacttggttccattctctctgtcactttcaggtacaccaatcagacgtagatttggtcttttcacatagtcccatatttcttggaggctttgttcatttgtttttattcctttttctctaaacttcccttctcgcttcatttcattcgtcttccatcactgataccctttcttccagttgatcacattggctcctgaggcttctgcattcttcatgtagttctcgagccttggctttcagctccatcagctcctttaagcacttctctgtattggttattctagttatacattcgtctaaatttttttcaaagtttttaacttctttgcctttggtttgaatttcctcctgtagctcgtagtttgatcgtctgaagccttcttctctcaacttgtcaaagtcattctccgtccagctttgttccattgctggtgaggaactgtgttcctttggaggaggagaggtgctgtgcttttcagagtttccagtttttctgctctgttttttccccatctttgtggtcttatctacttttggtcttgatgatggtaatgtagagatgggtttttggtgtggatgtcctttctgtttgttagttttccttctaacagacaggacccttagctgcaggtctgttggagtttgctagaggtccactccagaccctgtttgcctgggtatcagcagcggtgtctgcagaacagtggtttttcgtgaaccgcgaatgctactgtctgatcgttcctctggaagttttgtctcagaggagtacccagctgtgtgaggtgtcagtctgcccctactggggggtgcctcccagttaggctgctcaggagtcaggggtcagggacccacttgaggaggcagtctgcccattctcagatctccagctgcatgctgggagaaccactgctctcttcaaagctgtcagacagggacatgtaagtctgcagaagttactgctgtctttgtttgtctgtgccctgcccccagaggtggagcctacagaggcaggcaggcctccttgagctgtggtgggctccacccagttggagcttcccggctgctttgtttacctaagcaagcctgtgcaatggtgggcgcccctcccccagccttgctgccgccttgctgtttgatctccgactgctgtgctagcaatcagcgagactcggtgggcataggaccctccgagccaggtgtgggatataatctcctggtgcgccgttttttaagcctgtcggaaaagcacagtattggggtaggagtgacccgattttccaggtgccgtctgtcacccctttctttgactaggaaaaggaactccctgaccccttgcgcttcccgagtgaggcaatgcctcgcactgcttcggcttgcgcacggtgcgctgcacccactgacctgcgcccactgtctggcactccctagtgagatgaacccggtacctcagatggaaatgcagaaatcacccgtcctcttcatcgctcacgctaggagctgtagaacggagctgttcctattcagccatcttggctcctcctcctgtttgttttttcttataaatttaagttccttgtagactctggatactagacgtttgtcaggtggatagattgcaaacattttctcccattttgtaggttgtctgttcactctgatgatagtctattttgctgtacagaagctctttagtttaattagatgccatttgtcaatttttgcttttgttgcaattgcttttggtgattttgtcatgaaatctttgccaatgcctatgtcctgaatggtattgcccagattttcttctagagtttttatagtctggagttttacagttaagcctttaatccatcttgagttaatttttgtataaggcataaggaagaggcccagtttcaattttctgcatatggcaaatagtagcaaaaagagctgtgattattatattaaagtcaaacaaaatacacattgtgtcaaatattgttaaaagaaacaaaaaacatgattatatatcgataaaagggtcaattcatcaaaaagatataaaaattataaacatatacacaccaagcaatagagcttcaaaatatatgaagcaaacaccacaggattgaagggagacgaagcactacaaaatagttggagagttcaatatcccaccatggcatcataagaaatatatttggtctttgtccccagttcctggcacaaggttcctaaaactcttggaatttcctgagtgatgggtgtgtcttttgatattcataagaagcccctttcgattccacctcagtttctgctaatgaggttacttggagtggggcccctaggtagcctcaggatggagctggtcaccagaaaggtcaagtgattagaggtctggaaattttagacccacccactctcctccaggaagttaaagaaggaaggagttgaagctctataaaaactcttaaacaataagatttgatgagcttctgaattggtgaacacatccatgtgccaggagggtggcacacacaactcacaaggacagaaattcctgtgcttgggacccttctgaagctcaccctatttacttcatctggctattcatttgtatcctttataataaactgataaaccttaagtaaagtgtttcctgagttctgtgagctgtttcagcaaattatcaaactttcagatgggattgtgggagcccctgatttatagccagtagatcaaaagtgcaggaggcccaagacttgcaactggcacctgaagttgggagtagtcttgtgaaatcaagcctataagctgtggggtctgcactaacttcaagtagttagtgtcagaattaaattaaattttggaacacccagttggtgtccagagataggagaattggttgttggtgttggaaagcattccaggccctctttcaataatgaatagaacatgtagacagaaaaatcaataaggaaatagggtactaaacaacactataaacctaagacagacctaagacaagaagagaatgcatattcttctcaagcacatatggaacatactccaggataaactacatgttaggccacaaaacaagcctaaatacattttaaaagattgaaattatacaaactatcttctccagccacaatggaacaaagctagaaatcaataagagaaggaaaactggaaaattctcaaaaatgtgaaattaatacactctaaaacaaccaatgagtcaaagaataaatcacaacggaaattagaaaataatttgagccaggcatgttgactcatgcctgtaatcccagcactttgggaggctgaggtgggtggatcacttgagcccaggaattcaagaccagcctggcaacataaaaagaccctgtctctacaaaaaactaactaactgggcatggtggtatgcacctgtagtcccaactacttagaaaaaaaactttcggatgaatgaaaatgaaaacacaaaacacaacatccaaaaacttatgagatgcagtaaaagtagttctcagggtagaaaatctataactgtaaatacttacattaaaaaagagcacggccaggcgcagtggctcacgcctgtaatcccagcactttgggaggccgaggcaggcagatcacgaggtcaggagatcgagaccatcctggctaacacagtgaaaccccacctctactaaaaatacaaaaattaactgggcatggtggtatgagccttgtagtcccagctactcaggagtctgaggcaggagaatcgcttgaacccaggaggcagaggttgcagtgagccaagatcgcgccactgcactccagcctaggcgacagagcaagactccgtctcaaaaaaaaaaaaaaaaaaaaagatctcaaatctgcaacctaactttacatcatacgaaactagaaagagaagaacaaatacacccaaagctagcagaaggaaggaaataataaacatgtgagcacagaaaaatggaataggaaatagaaaaccaataaaaagaatcaacaagaccaaagcttggtttttttaaaagatcaataaaattgaaaatctttagctagattgactaagaagaaaagagaaaagacacaaataactaatatcagaaattagagtgggacatcaccaccaaccttacagaactaaaaaaattataagagaatactatgaacaattttacaccaacaaattagataaccttggatgaaatggacaaattcctagaaactcacaaatcaccaaaactgacttgagaaggaatagaaaatattaacagacctataacaaataaagagatagaatcagtaatttttgaaaaatacacatgactctcttcaacaaaaagaatgcctagggctagatgacttcactgataaaatctataccaaacatttttttattaacaccaatccttctcaaagttttccaatcttaactgatacagaaaaagcatttcacaaaattcaccacccttctataattaaaaaaaattcagaaaactaggaaataaaggacttccttaacatgattaaaggtacctataaaaaactatatacaatgatcattatactcaattgcaaaagatcaaaatctttctcccaagatcagaaataagacaaggatgcatctttcaccactgctagtcaacattgtaatggagttctaaccaaagcaatcaagtaataaaaagaaataaaagtcatccaaattgggaagaaagtaaaactatctcagctgtttttgtaaacaccagcaatgagcaatccaaaaaggaaattaaggaaacaatttgatttacaacaggctatgaaaggataaaatacctagaaataaatttaaccatggaggtaaaagacttgtataccacaaaatacagaacattgctgaaagaaattatagaagacctcaagaaatagaaagacatcccatcatttttttttttttttttttttttgagacagcgtctggctctgtcacccaggctggagtgcagtggcatgatcttggctcactgtaacctccatctcccaggtgctgggactataggcgcatgccactacgcccagctaatttttgtattttctgtagagacagggttttgccatgttgcccaggctgatctcgaactcctgagctcaagcaaaccacctgccttggcctctcaaagtgctgagattataggcgtgagccaccacacctagctgacatcctatattctatattggaagacttaaaattattaagacggcattacaatgcaattccaatcaagttccaacaggtatttctttttctttttttttttttttttttgagatggagtctcgttccgtcacccaggctggagtgcagtggcgcgagctcagctcactgcaacctccgcctcccaggttcaagcaattctcctgcttcagcctcccgagtagctgggactaccagagtgtgccaccactcctggctaatttttatatttttagtagagatggggtttcactatgttggccaggctggtctcgaactcctggcctcaggtgatccacccgcctcggcctcccaaagtgctgggattataggtgtgagccaccacacctggccggatttttctttatttgagaaacagaaaacttgatcctcgagttcatacaaaactgccttttcattgttgtactttgtagggtctcccatttcccccattttgtgcgttctgagtgaaaaacagagagtgccttgttggctgtgtgacccagccagttgcatgtttttcccagcaaggctgaaccgaagccaaggctttggatagccaaagcagtcttcaaaaagtagaattcacacttcctgattcaaaaataagccaatgatttaaatataaaagctacagaattcttagaagaaatgtagaagtaaatcttcatgactatggattgggcaatggattcttagaaaagacaccaaaagcacagtaacaaaagaaaaaaaaatcggacttcatcaaagttaaaaatttttgtgcctcaaatgactatcaaaaaagtgaaaagacagcctatggaatgggagaaaatatttgaaaaaatcatctatctggtgagtatccagaatatattaaagaactcttatgactcaagaagaaaaaaaaaaaaaaacccaattacaaaatgggcaaaggacttgaatatacatttcttcaaagaaaatataaaaatgaccaacaagcacatgaaaatatgctcaatatcggctgggcacggtggctcatgcctgtaatcccagcacttcgggaggccaaagcaggtggatcacctgaggtcaggagtccaagaccagcctcgccaacatggtgaaaccctgtctctactaaaaatacaaaaatttgtcaggtgtgggtggcaggcgcctgtaatcccagctactcaggaggctgaggcaggagaatcgcttgaacccaggaggtggaggttgcagtgagctgagatcacaccactgcactccagcctgggcgacagagtgagaatccatctaaaaaaaaaaaaaagaagaaggaggagaaggagggggagggggaagaagaagaagaaagaaatgctcaacatcattagttattagggaaatacaaataaaaaccatgagataccacttcacattttttgactggctataatttctaaaaaggaaaataataagtgctgacaagcatgtggagaaattggaaccctcgtgcatagctgatagaagtattaaattgttcagccgctgtgggaagagtttggagtttcctcaaaaaagtaaacatacaaagttaaacatatgacccagcagttctactcccaaatatttacccaaatgagttaaaaatatatactcaaaaaaatattcatctacaaatgttcatagctgcattatttgcaattgccaaagcaaggaaacagctgaaatgtccatcaacagatgaatggataaacaattgtgatatatatatatacaatggagtattattcacccataaaatggaatgaagtactggtgcatgctacatagtaaatgaacctcaaaaactacagaaataacatttcctacccaattgttttggaaaaaattcaaaagcatgacaacacgttctgttagtgagactgtaggaaacgtgcacagtcacattgttggtggcattacaaaaaggtataatctttatgaagtagaaatcggcaatatctagccaaactatatgtgcatttatcctcttttttctcttttgagacaaagtctagctctgtcacccaggctggagtgcagtggcttgatcttggctcactgcaacctctgcctcccgggttcaagcgattcttctgcctcagcctcctgagtagctgggactacaggcatgtgccaccacgcccatctaatttttgtatttttagtagagatggggtttcaccatgttgaccaggctggtctcgaactcctgacatcatgatctgccctcctcagcctcccaaagtgctgggattacaggcgtgagccaccgcacccagccgtgcatttatccttttaaccaatgatcacacttttagaaatttactgatattatacctccaacaatacagaaaattatgcataattgttcattgcagcattatttataatagcaaaatcttggaaactacctaaatgcccaaatataggagactggctatatgactaaggtgtatgtcaaatgcagctgtaatagaggaaaaattgttatgaactactggagagcagttttcaggatatattgttaaatgaaaacaacaaggtgcaaatgggtatattcgtgcaagaaaaacagagttgagagttcaagtaactaattatcttaaatcaagaatttatagagaattgataaagaagggctgctactcagcacatcctatgaagtcagcataaacttgctatgaaaccaagcaaggacaatatgagaaagacaagttacaggcccagttcattatgaacatagatgtaaaataccttaaaaatagcaaactaaaccaaacaatataaaaatgataatattcaatgatcaccttatattaccatagaaatggcttaatgtttgaaaatctgaatgttcactgcattaacagattaaaggatataaaaatgttatcatctcaatatacatagaaaaaagcaatacatataatctgacataaactaatttaaaatttcttgttaggaatgaaagaaaaatttctaaacctgatagagggtacttatgagaaacctaaagtggagacaattctaaaaggggaaacaagaagttttcattttaaatcaggtatcagacaaaaatacacactatcaccacttacatatgatgtactcaagggcctagcgagcacagtgaggcattaaaaatggcataaagtttgaagaagaaaactataactgcttatttgcctatgataaacactgaagagaacacacaaagaaaccataataaacaatgggagaatttagcaagctaactagttacaaatttgtggaaagaagaaaagatccaagctttaaagagaggaaagcaagtttgaaatagtatttgtagaaagtgggaacactggcttactgaagaaacttagtaagattgccagaccctttttggtttggtgatggtgcatctattgtgctgtttagtagcccagttgagttattttcccccagcaacaattatctgcctaggttcaagcttcaatgaaattgatggttggattcattcagggttgcagtttttgtaggtagattcaagcaaggagatttaaatgacaggttctgagtcctacattgatagaaagaaaagtaaacgcctataggggaggactacgaaatagggaagtgaagagtcaatgtttattggtttcagtgaggtcaaataattgtcatggtggagatttttgagcaaactggaaagttaacttctctacattagcagtaaacaaaaggaattagttgaaaagttatgataacatttacaatttccttttaaaaacttcaagcctcagaccaggcgcggtggctcacacctgtaatcctagcactttgagaggctgaggagggcagatcacctgaggtcaggagttcaagactagcctggataacacagtgaaaccccatctctactaaaaatacaaaaattagctggacatggtggtacacgcctgtaatcccagcaactcaggagtctgagacacaagaattgcttgaacctgggaggaagaggctgcagtgagcagagatcgcaccactgcactccagcctgggtgacagagccagactccatcatctcaaaaaaaaaaaaaaaaaattcaatcctctgtgaataaatataacatgtacaatttccacaggggaaaattataaaaaaatgttaagggacatgaataagatctagatacagatgaaagagatagcaaggtcaagattaggggaataaaggaggatatgaaaacactacgtgaccctggagtgggtgtgattgggaggtgcttggattcctgccctgccggttttgattggagtacacggtgaaaggctagtcacactgggcctccactttgccctctttccttctcttctcctcacagcagtgcctggtcaaacccagcaacccttggccagaacttactcacccatcccactgacaccatgaagcctgtgctgcctctccagttcctggtggtgttctgcctagcactgcagctggtgcctgggagtcccaagcagcgtgttctgagtaggtgctggatctgggcccaaggagggaagtaacatgtgtggataggagaggatctgagggctgacagtctgtcacacctcttggaaaaataccgtgtcatgttcaagggcccaagctttattgttggcaagatctaggtttgaatccctgctctgttgctgagtgaccttgggcatagtatctgggcctcaggtttttatccttataatgaatacaggaggagaacagataatgcatgcagacatagctcactcttactaaaccatggtaaatgctcagtaatattaaatgctgtaaatgtgatcagcctcatcatccagcttagtcttgctgcccgtggctccttcatggatgcttggactcacttttcaagcaataaaacagagagacaacgaagttggtagaactcaagctagaatctacataaccttggccttggaggatgttttgggaaggagggaaaggaagtcttgccttttattccacattttcaaactccagaggtactgtacaattaccggtaattagcatcaatgggacagtgtagagtccatctcagcagccaccactgcccagctcaactcaaaagagctctggctctagtaatgttgaccttaaccaataccaagtgggaaaagaactgttattcatcatacatccactcttctatggggaaaacatcttcagaatactggcggctcagaagagggataagtgtggtagctcatgtgtctggggaggctaggtcctgcttaagaagtttcagaaaaggcatgcaggtttgtaggactaagagggactaagcaagctacaagaaaataggagtgcccagggtagagttaattggagaatcagaatttgaggaaaggcacaaagaggctttctaaaagactggtaaatgctgtgagtgaagttgggaccagatacccagaagaggggtcaagacttgaaaagggtgacctctctgagatctctggatcatggtgtctatctctaaactgctctgttgagccccaagctcttcaaagtgtggattagttccaatttcttgcagtgccccagtgagctatagaatagctgagaggccaggggtgagtactagttattggtctctgttaaattgtcaacagcttgaacctcagcttcttttaccccaattctggtgccatttgctactacagttatagtcatgacctctttcttcattcattcctttcaaatcatcataatatcctatagatttccttctaattgcaaatatttgcagaggaatagacccacaattcctctatttgcaatagaatgccccacttttgacttttgcccccaaagaaagggagaatcacaaggtacaaaaattaggacctggaagggcttggggaaagggattaatggggcccatctttagagtccaggaatagaaaggagattgtgggttgtggacttagggaagactctcccagggcaggtaggtcttagctttgaactgaaatacttgggggtaggggaggaaataggaagtcaacataatgatgcttattcttctctaacagtagaaagtggggcatcctggtgctctggcctcctgatcgagagacaccaaggaagaaaaaagctgaatctttgaacgccattctgaaatccccacccttcttaccatgaaagaagtcactcccagaacttacttgtgaattgggtcccagctctctgatccagtaccttcagtttaatgcatggtcttcatcctttaccaaaacttacctttcactcattcttcctgtacacaaataacccatgttaggttaaccccagggtaaactatgttgttaatgagaagctctacaacttgctcaagaccacacaatgaatcagtgcagaacgaacatacaaacctctttcttgttcaccacatacaccattgatacccttgatatggacacaaccatagtcaatgggggcttggcatctgaactacaaggatggtgaatgaccaatgggtgcagggttctaccaaactctgttcttgatcaaaaaatatccatgccctgcttccctgctcagaactcagaggaaggcagcagctgaggacaaaacctgatgccaccaccctggaaccatgcaaggcagatgagggtggcaggtttcctggcagttccctgggctttctgagttctgaacattactccagcctgttggtgaggcccttctcttacttgttctgtgttccagagtatatcttggaacctccaccctgcatatcagcacctgaaaactgtactcacctgtgtacaatgcaggaagattgcgagaaaggatttcagtgctgttcctccttctgtgggatagtctgttcatcagaaacatttcaaaagcgcaacaggtaagagatatctcatatccaggtctgatcctagagctgctggtgggagcccagcagaagagtcccttaccagcaactgtgctggatctctccttttttttttttttccttggtggccatgttgccaacatgccccttctcttgaccaaggataatttccataaaagtcctgattagaaaagccctcctcccctcccaatcaccacatcccatcaccatatccgtgaatttctgactctgcctctctgaacacacccacaaatgcctttatccacagaccttcccccgacccagaatccacccttatcccagggacactgtacctgcaggtgtaaccaaaatcccaaagcaaaatttgtcctacacttttgcttgccctcctttcacaagacaccatcctttggccaccagtgttcttgggctctggagatccagcccaaaggaagttttgattaattgtccagacattaacactagccgcaagcctgctaaatggagtgtgctcccagggcagagaaaggacatagggtgctgatgagacatatggtttctaatcccatcttgcaactatgtctttctatgaccttgagtaagacaattccctcttttttactttctttttctcatgagtaaaataagtactcttgttttttcctgctttgcaaggcccatatgaaatttcaaaagactcacagtggaagactcaaccaatgagccctttgagggaagcctggcagtcttgttccctgctgtattccctaccatgagcagaatacccagcatgagataatgtgcagagtgattaagcatgggctcaaagccaaacacctgggctcaaatcctggcttcttagctaagtgaccttaagtgatcttagacaagctaattaacctctctctgggcatcaacttcctcatccttaagactggaacaataatagtgaggttaaaatagacaatccatgtaagctttaaaacattacttgccaacataattgctgtgaattttggggattaggcaaccacttctctttgaagagactagcccttgcaattaaattccacatctttcaatgctctacattggaatgcagaagcataaatataactctttggtgtcattgagttttttgaggttctgccttccctatggcaagagaaatgagcttcatggtctaatattaatggtggaagtaattgaaagaaaaatatatatctctaaaagtaaaacttcactagttaatatttgaaaatatttttcttctacagaatcaaacacaagggctcagaagtcatcatgcctgccaactgaggcatatttcctagatcattttgtaagtacagggatttggtctcgccttcctcatgtgagattcccagggatgctcactttcttcctgtagcctcaccaggggcactacattcccacaagctcagaatggcctctcattacctgattgcctcctcctccatcattcccctccaagggctatctttgcactccctgggggaggcacggtgcagtccagcatgaattctgcaacacagagcaatgtaaggaaccaagtcatggcccagggggaacccagggcactcagatctgaggctttgtcaaggaacaagctcttctagcctccgggttgacagcaccctgggcagggactcaagctgagcccttcacgctctgagactttggtctgctcactgtacctctctgagacagtcacctccctcatgtgaaatatgaagaaaacatccatgccttggggtattgggaggacaacacaaggccatgtagatggaagaacttggtctctgcaaaggtagaaactgccagcaactcacttacaaggtcactcattcaggttccagttttttctctgaaaaaagagggagtgggccgggtatggtgactcacacctgtaaccccagcactttcggaggccaaggtggacggatcacgaggtcaggagttcaagaccagcctgaccaacagagtgaaaccctgtctctactaaaaatacaaaaattagttgggtgtgatggtgcacacctggaatcccagctactcaggaggctgaagcaggagaattgcttgaacccaggaggcagaggttgcagtgagccaagagtgcaccattgcactccagcctgggcgacagagtgagactccgtctcaaaaaaaaaaaaagagggagtgggaatcatctttattattttactgatgcttcaagaatggtgaacaaaatggagtcctgtggaattccaccaccaaaaaaatgatagtattcataagttggtggatttcgtttcagagtatttgaaagaaaaagttagaagtttagggtcttctaatgggccttctgatgtctccagatgttccaaattagaatggtggtctttcagcttagtccttttattaaccctgtacaaaggagcgtgataaatagtagcaggtggaggccagtggagcagtttagacgcatgagcacttgcccaggctccggtgagcccaccatgctgcggatgagctcccactcatgcttcaaggtttctattaaattaaacactccatagaaacttcaccagttcactccagacagaattagtccctctctttgtcttttgtagtgtcctatctttggcctaccataacctagtgacccctgatccagggcaggaaatactgttcagaaaaatctatagactcttttactaccagaaactgaccatatgtggttcgagttgacctgagtgaggcaggtctcttacatacaggttggctatcactgttttaataatctgagtttgatctatccaatactgtaggcactggtcacgagaggctatttaaatgttaattcatatgaattacaataaaataaaatattcaatcagttccttagccttattttccatttcaagtgtttaataaccacatgtggttagtagctaccatattacacattataaatacagaacacagaaagttctaatggaaagcattgctttaagctacataaagctgatgtctaaaaaatgatggctaattaaaggtgatcatgacagaggacaccctctatgacagcctcatgttagactccaggaaaagtttttgggggctatttctttaaggagttcctaagcatagcctgacaacagacagttcaatgacagtaattctctagagacccaacatgatgtccaaggatgtttaaagaatcaagaagaataaatggactaattatctttccttccccacaggcctctacgatgttttttcttggtccacctttaggaaggtattgagaagcaagaaactggaggcccaatatctaacctgcaaatcgtttttgagtttggcaataaaggctaatctaccataaaactcttgaagcttaagctttaggtcaacacttgcaagagccccttccaaagctcagcacagtttcctcctgggatgaggagaggaatcagaaaccccactttggcatagagacaagcagcactgttccagtccagggatgctgtgtgtgccctggtggtggtcttaaggacctaccacatcaacatctggacaaccctcactgattacctgcccttggttgcactcatcaggctaattgatcccatatttaacctcaaggagaaatatcaaccagacactgcatggcaacctccttggggccagccttcaaggcttcatggccatatcatgaacccaggacaggcacagtgggggtggtgaggacctgatagagttggatcagtgactaagaggctgcaataaggtgccatgaaatcaaaatcaaagggctagaactctccaaggtcttgcccccggcatgtagcaccacctgagccagaaactgcagaggacatgacagtgtggcattactgataagttatggaaatggaaataatctttcctaaactaccaataataactttaaatttttgatcaaccatgctagagcaaagattgaattatccttctgttctctctacagaaatgatataaaaactatagtcataagaagagacaatcaaaaataatcagccataaaatattaaaaaggtattataaaggtatttaaaataataataataaagtgttattttcctgggattcatgatatttgatatattcgtaagcttttgttaagtttgtaatttgttgcaatttctttttcatttcaaataaatattcacttacgtgtctaattttgtattagtagttctgcattatttttctaaaacaaggtatccataattatacaagcatcaagctccacaaagcctgggcctttctctgcttgcctccattccttccaactctgtaccagtgagccttgtgttcctcattaggaaaacagcataagcaattgttcttcattttcacaagactgtacaaaaagattaaacaatataatatgcataaaaatatgttgtacgcactgtgacagaaatatgaatggttatgattattgttaacattttgaggacttactgcaaagggtgagatataaggaatggcattaaggaagaagaaaaatggattttcaccccttcatcagtgaatataatctatacaccatgacttctcacttaaccatagttgtgctactatggcacatcatctaaattcttcaaaacttgaatttttcatgcttaaaatagagataacaccacttaccttacgtaatttgtgatactaagttcttgattgtagtctggtggttgggaggcttaattaaataaccagtaactcagcagtatcaacttgctttgaagggaacatggctggactggaaagtacctgacacacaaccacacaggacaggctgaccctccaggatgaaatcttgaagggatgtttcagccaatcatgagtttatttagtttattaagaacaagtgacaggcatggggaatcttggaaaagatgctctaatagataggtccaactcttccccaggggagtgaataaagatgaaaagctaagagacaagaatttggccacaatgaagccagaataaaactgttcaaaaaataacaatgcttatggatatcttgcaaattcttgctgggagttctcttctcagtccatcccagcagagatggtgaaagatcagtagttcagtaggggctataccaagtcaataaggatacttgggagacacaatgaaaaaagagtcactttttcttgctgtcacctgggaagaagataaatatgaagactatggccctttggagagcactcttgtactctgtcactgcctcctataagtgcttagtcaacaatccaacataattttaggtttgctgggaaaggtgggtttggctgtgttaggaatggaatttacaattttgaaggtgaaatcttgtttgttcatgggttctgcttcccagccttgcagccaagactcgtatacaacttttgaggacaaaactttaattcatttctatatacccaacattgagaatagttactgaaatatagcaggagctcaataagtaagtaccttttaatgagatgagaaaggataaaatgctaaaatattgaggcaggggaattgcttgaatccagggggtggatgttgcagtgagccgagatcatgctacttcactccagcctggatgaaagagtaaaactttgtctccaaaagaaaaaaaaagaaagaaagaaagaaaaagcacttgagaaaaattcaacatttttttcataataaaagctctcaacgaattaggtatacaagccacgtatctctatataacaaaggccatgtataacaagcccatagctaacatcatactcaatgatgaaaagctgaaagctttgcctctaagatcaggaataagacaaggatgcctactctcaccgcttctattcaacaaaatacttgaaatcctatccagaaagattaggcaagaagaacaaataaaaggcatccaacaggaaattttccaataggaaaattgtctctgtttacagatagcatcttatgtatacaaaactctaaagacttgataacaaaaataactgttagaattaataaattcaataaaagtgcaggataaaatcatcaatatacaaaaattagttgaatttctctacactaactacaaactatccataaaagaaatcaagaaaaataatcccatttacaatagcatcaaaaagaataaaataggagtaaatataaccaaagaggtgaaggatctgtacactaaaaactatagaatattgataaaagaaagtatagatgacacacaaaaaatgaaaagatatcccatgttcatgagttggagaaattaatattgttaaaatgttcataatgcttaaattactccacagattcaatgcaatctctaacaaaattccaaagatattttcacagaaatagaaaaaacaatcctaaaattcatgtgagccacaaaagacactgaatagctaaagaaattctgagcaaaaaggacaaagctggaagcatcacacgtcatgattttaaactatattgcaaactacagtaatccaaacagtatggtactagcataaaaacagacacatatggcaacgaaacagaatagagagcccagaattaaacccttgcacgtacagtcaactaacttccaacaaaggcaccaagaatatacaatggggaaaggataatctcttcattaaatgatgttaggaaaacttacaccatacacaaaaatcaattcaaaatggactaaagacttaaacataagacctgaaactgtaaaactcttagaagaaaacatagggacaaagttccattggtctggacaatgatttttttttatttgaaaccaaaagcacaagaaacaaaaacacaaataagggagaccacattttctgcacagcaaaggaaacaatcaacaaaatgaaaatgcaacctatggaatggagaaaatctttgtaaaaaatacatttgataacagttaatatgcaaaatatataaagaactcctacaactcaataacaaaaaataaaaaataaaaaaatagtaaaagtccccaaacagacattttttcaaagacatacaaatggccaacaagtctatgaaaagatgttcaacatcattaatcattatgaaaatgcaaatcaaaaccacatgagctatgacatcacacctgccaggtgcctattatcaaaacaaaagataagtgttggcaaggatatggagaaaaggaaacccttgcacaccattagtgggaattcaaaatggtgcagccactatgcaaaacagagtgaatgttccttttaaaattaaaaattgaactaccatgtgatccactaatcccacttttgaatatttattcaaaattactgaaatcaggatctcaaagagatattaacacttagcacctctatgttcattgcagcactagtcacaacagccaagatgtgaaaacaatcttatgtacgttgacagatgaagacatttttttgaaatgtagtatatgcatacaatggaatactattcagccttttaaaaaaaggaaattctgcaatatgtcacaacatagatgaaccttgaggacattatgccaagtgaaaaaagccagtcacaggaagataaatacttcacgactccacttatatgaagtatctaaaatagtcaaatttatagaatcaatagtggaacagtggttgccagggcctgggtggaggtgaaatggataattagtaattaacaggcataaagtttcagtcaagcaaaagaaataagctctagggatctagtatacaacactgtacctatagtcaacaaaaacgtatcatacacttaaaaatatgttaaaacagtagacttcatgttaagtgcttttaccacaataaaataaaatttgaaaaaagaaagaataggggctgggcacagtggctcatgcctgtaatcccagcactttgggaggccaaggcaggcagatcatgaggtcaggagtttgagaccagcctggccaacatggtgaaaccccatctctactaaaaatacaaaaattagccagacgtagtggtgcacgcctgtaatcccagctactcaggaggccgagatgggagaattgcttgaacccagtgggcagaggttgcagtcagccaagatcacgccactgcactccagcctggatgacagagtgagactccatttcaaaaaaagaagaagaagaaggaataggaagtcattaaacaagtttactaagtagaaacaatctcctaaaacagaaaacaccaagtccacatgattttcagaaaagttcaatcaaatcttcaaggaataaaccatttcaatcttatatgaaatcatccagagactagaaatgactattcctgaattcagtctttgaggccatatagtcttagtgctcaaaccaaataaggagagcatgagaaatgaaaactactggccaatctaactcacaaacgtagatagaaaaatcttatacagcatattagcaaactaaattcagtagtgtataaaaagattatttagcataagcaactttatcccagaaatgcaagagtaaaaatgagaaaaacctacaaatacaattcaccgtataacaatttaaaagccatgtgattatcccaacagatgcaaaaaatagttttataaaattcaaattttgacagattacatttttaacacactgggaatataagggaatatccttaacaagataaagtgtaggtattttttttaaataaaacctacagtatacatcattcttaaaggtgaaactattagaagcagtcccttaaaatctgcaaaaaaaagacagggatgaccactacactgcttctattccacaatgtactaaagattctagccagagtgatgttaaaaaatagaaatttaaagcattcataattggaatagaaggcacaaaaccatcattagtcacagatgataactgcctatttttgtagaaggcaaagagaaccacatacaaattatttagaaataacaacagaatataggaaggtgactggatataagattaatatataaaatgaattacatttttgtacaccagaaaaacatagaaagaaatataatgtttaaagataccatttaagatggccaattacaggcagctgcggtcacagcactgctgaggaaggagagcagcaaagtgaattcaccaccttcaactgaaatatccaggttctcacattgggactgactaagcaatcagctcaacccatggagagcgaagaaaagcagggtggggtgagggcccacctggagcaacatggagccgaaggaacccccatccccaaacaagggaggcagtgagtgattgtgcgaccctgcctgggaaaccacacttctcgcacagatctttgcaacctgcagatgacgagatcccctcatgagcctacatgagcagcgccttggattcaatgcacagagctgtgtggagtctcagcagagcagcaatccagcacacacagagacccaggagttttacatactctggcctcgggatccccaacaagggggcagatccatctgtatattcccctaggaaggtggctgaatccagggagccaagcagcatcattctgcaggccccacttccacagcacctcacaagttgggacctgctggcttggagttccagccacagtggcagtaggcggagtctgcctgagactgggggagtttccaggacctggggggaggggtggctgccatttctgcagtttggtcaactagtatttcagcttgccagctctggacagtccaggcagtctggactagtccccttctatgcagcacacctgctttgccagatcgtgacagactgcttctttaagcaggatcctgatccattcctcctcactgggtggggcctccctgctgggagccctcagtcaccccagccaggcttatatggacagaattccgatctctccctgggatggagctcctatggggagaggtggccaccatctctgcagttgagttgactcagctgttccagcctgccagctctggagagtctaggtggtccagacaaggaagggtccccaccaacacagcacacctgctctaccaaaaagcagccagactgattctgtaagcaggtccctgatcccattcctcctgactgggtgagacctcccaacaggggtctccagacacctcctacaggagcattcaggccagcaacaggtcagtaccccctgggatggagcttccagaagagaagcgggctttgctgtttcgcagccttcactggtgatacctagagttacaggaaaagccaaggcagctaaggtctggaatggacccctagaaagccacagcagtcctacaggtgctaacagtcagtggcctgttaaaagaaaaacaaacaaatagaaaacaacaacaacaaaaaccccaccaaaaaaccccactcaaaggtcagcaaccacagaaaatctaaggtagataagcccacaaataagagaaaaaaaatcaatgcaaaaatgctgaaaactcaaaaagcaagaatgcttcttctcctccaaatgaccacaatacctttccagcaagtgcacagaactgggctgaggctgagatgacagatgagatgaagcttcagaaggtgggtaataatgaactttgctgagctaaaggagcatgttgtaacccaatgcaaagaagctaggaatcatgataaaacaacacaggagctgacaaccagagcagccagtttagagaggaacataactgacctgaaggagctataaaatacaacacaagaacttcacaatgcaatcacaagtataaatagcagaatagaccaagcagaggaaaggatctcagagcctgaagactatctatctgaaataatagaggcagacaagaatagagaaaaaagaaagaaaagcaataaataaaaactgagaaatatgggattatataaaaagactgaaccagccaggcacggtggctcacacctgtaatcctaggactttgagagactgaggcgggtggattgcctgaggtcaggagttcgagaccagcctggtcaacatggcgaaaccccatctctactaaaaatgcaaaaattagctgagcatggtggcaggtgcttgtaatcccagctactcaggaggcagaggcaggagaatcgcttgaacccagggggcagagattgcagcgagctgagattgcgccacttcactccagcctgggtgtaagaatgaaactccatcttggaaaaaaaaaactgaacctacaactgattgggatacctgaaagagatggacagaatggaatcaagttggaaaacatccttcaggatatcatccaggagaactccccaacctagcaagacaggccaacattcaaattcaggaaatgcagagagccccactaagataccccatgagaagatcaaccccaagaaacataattatcagattctccaaggtcaaaatgaaagaaaaatgttaagggcagccagagagaaaggccaggtcaccttcaaagggaagtccatcagactaacagtgaacctttccgcagaaaccctacaagccagaagagattgggggccaatattcaacattcttaaagaaaaaaatttccaacccagaatttcatatcttgccaaactaagcttcataagcaaaggagaaataagattcttttcagacaagcaaatgctgagagaatgcatcaccaccaggcctgtcttgcaagagcaccttgcaaggaaggaaggaagcactaaatatagaaaggaaaaaccattaccagccactacaaaaacacactgaagtacacagaccactgacactatgaagcaaccatataaacaagtctgcaaaataaccagctagcatcatgatgacaggatcaaattcacacataatgctaaccttaaatgtgaatggctaaatgcccccaattaaaagacacagagtggcaagctggataaagagccaaggtccatcagtatgctgtctcacaagcaaagatgcacatgggttcaaaataaagggagggaggaaaatttaccaaacaattggaaaacagaaaaaagcaggggttgcaatcctagtttctgagaaaacagactttaaaccaacaaagactttaaaaagacaaaaaagggcactatataatggtaaacggttcaattcaacaagaagagctaactatcctaaatatatatgcacccaatacaggaccacccagattcataaagcaagttcttagagacctatgaagagacttagacttccacacaataatagtgggagactttaaccccccactgacaatattagacagattatcaagacagaaaattaataaagatattcaggacttgaactcagctctgaatcaagcagacctgatagatatctacagaacattacacccaaaaacaacagaatatgcattcttctcatcaccacatggcacttactccaaaattgattacataatcaaaagtaaaacaatcctcaacaagggcaaaagaactgaaatcataacagtctctcagaccacagcacaatcaaattaggattcaagattaagaaattcactcaaaacaacacaactacatggaaattgaacaagctgctcctgaatgactcctaggtaaatgataaggttaaggcagcaatcaagaaattctttgaaactaatgagaaccaagagacaacataccagaatctctaggatccagctaaagcagtgttgagagggaaatttatagcactaaatgcccacctcaaaaacctagaaagatctcaagttaacaatctaacattacaactaaaagaagcagagaaccaagagcaaacaaacccccaaactagaagaaaacaagaaataaccaaaatcagagctgaaccgaaggagatagagatacaaaaaaaccccttcaaaaaatgaacaagtccaggagctgatttttgaaaaaaaaatcaataaaattgatagactgcaagatagactaataaagaagaaaaaagagaagaatcaaataaacacaattagaaatgataagggagacatcaccactgatcccacagaaatacaaactaccatttgagaatactataaacatctctatgcacataaaatagaaaatccagaagaaactgataaattcctggacacatacaccctcccaagactgaaccaggaagaaatcaaaacactgaatagaccaataacgagttctgaaactgagacagtaataaacagcctatcaacaacaacaacaacaaaaagcccaggaccagatggattcacagctgaattctaccaggggcacaaagaaaagctgataccagccaggcacggtggctcacatctgtaatcccaacaattacacatctgtaataccagccaggcacggtggctcacatctataatctgtaatcagaggctgaggcaggtctctactaaaaacacaaaaactagctatgcatggtgatgcatacctgtaatcccagatactcggggggcctgagacaggagaatcgcttgaacctgggaggcggcggttgcagtgagccgaaatcacaccactgcattccagcctgggtgacggagtgagactccatctcaaaaaaaaaaaaaagagaaaagaaaagaaaaaaagaaaagctggtaccatttctacagaaactattccaaaaaactgaaaaggagggactcctccctaactcattttatgaggccagcatcatcctgataccaaaacctggcagagatacaacaaaaaaagaaaacttcagaccaatacccctgatgaacattgatgcaaaagtcctcaataaaatactggcaaaccaaatccagcagcacatcaaaaagcttatccaccatgatcaagttggcttcatccccaggatgcaacattagttcaacatatgcaaatcaataaatgtgattcatcacataaacacagctaaagacaaaaaccacatgattatctcaataaacacagaaaaggccttcaataaaattcaacatcccttcatgttaaaaatgctcaatgaactagatattgaaggaaaatacctcaaaataataagagccatatatgacaaacccacagccaatatcatactgaatggggaaaagctggaagcattcccccttgaaaactagcacaagaaaaggataccctctctcatcactccttattcaatatagtattggaagttctgaccaggacaatcaggcaagagaaagaaataaagcacattcaaacaggaagagaggaagtcaaatcatctttgtttgcagatgacataatcctagatgtagaaaaccccatcgtcttagcccaaaagcgtcttaaactgataagcaactttagcaaactctcaggatacaaaatctgagtgcaaaaattgctagcattcctatataccaaaaacaggcaagcagagagccaaatcataaatgaactcccattcacaattgccacaaaaagaataaaatacctaggaatacagctaacaagtgaagagcttcttcaaggaaaactacaaaccactgctcaaggaaatcacagaggacacaaaaaaatggaaaaacattccacactcatggataggaagaatcaatgttgtgaaaatggccatactacccaaagtaatttatagattcaatgctattcccattaaactactattgacattcttgacagaattagaaaaatctattttaaaattcatatggaaccaaaaaaagagcctgaacagccaagacaatcctaagcaaaaagaacaaagccagaggcatcatgttatccaacttcaaactatactacaacgctacaataaccaaagcagcatggtactggtacaagaacagacacatagaaaaatggaactgaatagagggaactaagaaataaggctgcacatctacaaccatctgatattcagcaaacctgacaaaaacaagcaatgagaaaaggattccctatttaataaatggtgctgaaaaaagtggctagccacatgcagaaaattgaaactggactccttccttataccacatacaagaattaactcaagatggattaaagacttaaatgtaaaacccaaaactacaaaacccctagaagaaaatctaggcaataccattcaggacgtaggcatgggcaaagatttcatgatgaaaacaccaaagcaattgcaacaaaagcaaaaattgacaaatgggatctaattaaactaaagagcttctgcacagcaaaagaaactatcatcagagtgaacagacaacctacagaaatggagtatatttttgcaatctatccgtctgacaaagttctagtatccagagtctacaagaaacttaaacaaatttataagaaaaaaacaaacaatcccattaaaaagtgggcaaaggacttgaacaggcacttctcaaaagaagacatatatgtggccaacaaacatatgaaacaaggctcaacatcgctgatcattagagaaacgaaaatcaaaaccacaatgagataccatctcataccagtcagaatggtgattattaaaaagtaaaaaaaaaaacaaaaaacacagatgctggagaggttgtagagaaaaaggaacacttttacactgttagtgggcgtgtaaattagttcaactattgtggaaaacagtgtggagattcctcaaagatctagaggcagaaataccatctgacccaataatcccattactgggtatatacccaaaggaacataaatcattctattataaagacacatgcatgcatatgttcattgcagcactattcacaatagcaaagacatgaatcaatccaaatgcccatcaatgatagactggataaagaaaatgtgatactgaaatatatatatatacacacacacaccatggaattctatgcagccataaaaagaaatgagatcatgtcctttgcagggatatggatggagctcgaagcagttatcctcagcaaactaacacaggagcagaaaaccaaacactgcatgttctcacttacaagtggtagctgaatgatgagaacacatggacacataagtggaacaacacacactggagcatatcatgggggtggtagggagagggagaacatcaagaagaatacctggtgaatgctgggcttaatacctaggtgtagggatgatctgtgcagcaaatcaccatggcacacatggtttatgtatgtaacaaacctgcacatcctgcacatgtaccgctgaaattaaaataaaagttgaagatttttttaaaagatagcatttacaataatattaaaaatataaataagattgtaacacctgcatgagaaatgtcataaacctttctttaaaatattaatgaaggtcaaaatagatggaaatatatatatcaaagacaatattataaggatatcattcttttccaattgatttgtagatccagtgcaattcaaatgaatatccaaaataggtgttttgtttttgtttttgtttttgttttcgttttcggtcagagtcttgctctgtcacccaggctggagtgcaatggcacagtctcagctcactacaacctctgcctcccagttcaagcaattctcatgccgcagcctcccaagtagctgagattacaggaactcaccaccataaccagctaatttttgtatttttagtagagacggggttttgccatgttgaccaggctggtctccaactcctgacctcatgggattcacccacctcagcctcccaaagtgctgggattacaggcatgagccaccacgcctggcccgaaacaggtcttttgaataacttgataaactgactaaaatttatatgaaaatacaaaatcctaagataaacaaagttcaagagattaagtgtggctttggagtgggggtatacagtggagtgaaataaagggctcagaagcaatcccacataattaagcaaaattattttgcagttaaatagaagaggaactcattaataaataggtctggaaccactgaaaaatgaaaaaggatccttatgttataccttaccaaaaaatcaacatcaggtggttttagggtgtaaaggtaagccaaaacttcaaaacttttaggagaaaacagatccaagatgtcctcatgttcctagataacatagtgtagtgtgactaagaacaaaaactctgaagccaagttcaaatcttgtctctaccacataataaatgagtgaccttgtacatgtaacctaatctctgtctccatttcatccttaaatgatggtaataactgtacttacttcatagggtgtatatgatgataaagtatatacaaattacttaaaaatagcacctggaattaagtagtactctaggttataactaaccctgttactattattatagtgctattgcactctttctcttgtgccatgattagtttcttctgtgcataaaaggtcaaaaagagaaaggaagaaatccctttttaattcctcactctgatgattctacccttcatgattaaatatatgcagaagctctgatccttaagtttctattgcttctagatgaacatgggactcactatcaagggtctaatcagtttggggccttcagcttcatggctgggtacccaagcactcactgttcaactcaacacctagtaatgtccagtcctggcccttggggtaggtgagctcaaccgtctcaagtatcaagcccaaaatataacatcaggtgataccacaactatcctgcctgctgcttgctgcaccatgaagtctgccaagctgggatttcttctaagattcttcatcttctgctcattgaataccctgttattgggtggtgttaataaaattgcggagaagatatgtggagacctcaaaggtatgaagctaaggcagaaaataaatccaaaggtcaattatgaatgagagagaaggtattgggagaaaagtgtgttatctaggtagtccaggaaggtcttcctttcatgacaatacccatagacacttagtcccttgactcagggcattacttacactaggggtcctctggatgtttgatgagaaaaaacagaaatgacacaaagtcctttccagatggagacctcttttataggaggtccaaaggactggaagtattttgaatcagaggttgtgtgacaaatttcaaagatcccagaccattgatgattatgtattgggatgagagagaaagggggttggagacagagcaaattaagacattttcagtatctgggctatggacatatacagaactcttggacagatgattcctgtttagaggagctcacaatgtaaatgtgagaggcaatgagactttcttccatagatagtgtgtgaaggctcagcgcttccaggggacgagaaagtagcacagtttataccgtaagtcagacacttcaagttctggacctgttcacttagcagatatgtgcccttggacaagtcactcaaccacttattattctcttagtctcagtttccccatgtgtaaaatgaagatcagaaaagtgcctgctgcagagggtgtttgtgagtatgaaataagattatgcacataactttaccagagagtaaattccaggctggctgcttgagtaaggtggattgtcaatacaaccatgattgtggctgttccaaccacttactacccaactcttaacaataaaaacagagggtttgcctctgagaaggcaagaaaggagaagatgacggggtatgaggatgaacgagcatcaccccaaggttatgcattttagcattttagtatgcatcctgctttaaagatagcagcagccatggttacttaaattttgaagtataggtagtatagtgaatgtatgaaactggggaggaggcactctgaattgcatgtcctatgtgggcaattaaaaggaaaggaagatgatgtggggaagcaggaggatactgtactttaataaactgtaagataggaaatgtagggaagctcatcgccctgcacaagctagtggtggaacctcctttttcactgatcactacttctccttctccaatacactgctcacgacaacaacctggaattttaaccaatttgcattgtgcaagggcaacatttccaagcaactctaactccaagagaaaaccacatctttcagagtccttgaatatgagaatagttccaggctaaacgtaggaatttttaagggcccataaagacaagttctcctgctgagtccttaccaattcccactaactcaatgggaacctctcatgcagatccctgcaaattggacatgaattttggaagctgctatgaagttcactttagatatttctacaacagaacctccaaaagatgtgaaacttttgtcttctccggctgtaatggcaaccttaacaacttcaagcttaaaatagaacgtgaagtagcctgtgttgcaaaatacaaaccaccgtaaggaatctaatcctgtccttggtccttgggggtagtaaaagaagaggttttgacatcctaagatagagaaaattgatcaggggctaaccttgcttggagtgggaagagggaggattgctcaaataagaagttttaacagttgggttggccgggcgcagtggctcatgcctgtaaccccagcactttgggaggctgaggtgggtgtatcacctgaggtcaggagttcaagaccagcctgaccaacatggagaaaccccatctttactaaaaatacaaaattagccaggcatagtgtcgcatgcctgtaatcccagctactcgggaggctgaggcaggagaatcacttgaacccgggagggttcaagaagttcagagggttcagaggttgcggcgagccgagatcgcgccatccattgcactccagcctgggcaataagagcaaaactccatctaaaaaaaaaaaaaaaaaaaaaccacatttgggtgggctgtcaggatcatttgctcattttgcagttaggaaatcaaatgcccagagagaaaataatagccaccatctattggacaattactgtgtgtcaggcactgcactaagcaattaacatatattgatataatttaaaattatatcaaggtagggccaggcgtggtggctcacgcctgtaatcccagtactttgagaggccgaggtgggcggatcacaaggtcaggagatcgagaccatcctggctaacacagtgaaaccccgtctctaccaaatatacaaaaaatttgccaggcgtggtggcaggcgcctgtagtcccagctactcgggaggctgaggcaggagaatggtgtgaacccgggaggcggagcttgcagtgagccaagatcatgccactgcactccagcctgggagacaaagtgagactccatctcaaaaaaaaaaaaaaaaatatatatatatatatatatatatatatatatcaatagatatatatcattatttttatgtgacagatgaagaaaccaagtacagtacaagtaaccaagcatctcgaggtcacattattaaatggcacagcagggtttctaaccagagctgacagtcacaatggtcttgacaatcttacatggacaaggtcacccaaaccaaattcttgcactctcatacctttgaactcttcatagcaacttgctgctttatacaactaagctcccagcccatgcttgactatttcccaatcattggaaatagaaggtcaatggtgcctaacagggctgtggtttggctgattcccaggagaactggctggagagtggccttgggagtaactagaaagcagaaatgttgttttgtttattttatattcctagtggatcttttcagtgcctggcacatactaagcaatgattaagtgttaagtgaatgaaaaagtgaaagattaatcaataaaataagggaaacattgagatagaaggcatcctctgtgctttccctaggataaaaaatgacctgcattaatccagggagaccttcaaaaacctgtaacaccgatttgggtttttctttcctttgcttaaacaggaggtgagaggatgtgaactcatgaagttgtctgctgcaccatccgaaataaagacacaagaaaattcagactgattttgaaatctttgtaatatttccataatgctttaagcttccatatgtttgctattttcctgaccctagttttgtctttcctggaaattaactgtatgatcattagaatgaaagagtctttctgtcagccctggctctcttaatttctctccacttgtcttatctggatttgcagagctgaaatgtcagctggtcccatccattgatttccccctcactcctgagccatcccttacatatgcacacttagcttcatttatcctaaactgctaaactgtttcaggtttgacaagtctgtacaggtttgcatcacctcccctgtcaaattgaactggttagtggaaccaaagtaccaaacctatactcccttttgatcttgaaatcaaacctagcagcgaactgcacacttatgtgaaatgtccctgcactcataacaaatttttctttgtcgtgtttcctgattcaagtccctcaattagtttaattacctcccaacctggtccctgtttaggagtaattatatggacctctgtcattgctatttgacttgattatagtcagtccttctggaaaagaatcctcaacttcagtccagtgactgtgtttcagctaccaaaaaatgattatccaaacacaggttcccaaatcttctgcatataatgctacaaggtttggcatggccatgatcagcctagctgtaagatttacaagttgaccacttcacctctgaattttttcaggcatccaaactgaacctgcactgaagtaggaaaacctatcctggcacctgttattaccctctgcatatctaccatgtccatcttatagacaaagccaatccctcacctgtgaatcacaacctggaacaggggtagctagggccaacattgtaaaccagtgagaccataactagacacacaagcctgatctctgctccatcttaagactaggaagatcaatgccctaaattaagatgcttttctgcaaaaattctggtaactacaagatcataccctcaaccagacagggtttattctgagcaggtaaagtgctaataacccagttgattctggcatatttcatcttcaatgaagatcctaaaattatagatcattcttgagcccagccagctgcaagaccctaaaataatagagatgagactaatctaattagtccacatacacagaagttctgagattttcctgttatgaatcatgaaactgggtgtcccagaagcagacagtctttcagggacaagatagcatatttcgggagcctgtttgcttcctacttcagccaactccttgaaaagtcagagaagtaaaaaagaggtgtacagatatgaataaagtcaagactaagaatcctctgaggaaagaaggcaattgtatcctggtgagaaaaggaaatagatgcccaggacagattgttgagcatcaaaagtgagataatgagttgagtaagagcttttgaggctttcgagttgtgttattctccccaccacaaagatctggatcagtcattgcctgctctcttgccaaatcactaacagccacaaaataccagataacatagtggtcgttccagagtccagctagagaagtataaaagcataaaagaagtgagaagcataaaaacaggtgcaactgagctagccagacacagagtttactgttttctcttcctcctatatacagtaaggtttatgtgactaaaactaagaggaagaaaggttcctagaaaatacatctaggacagaagtgtagatattttctctggttggaggtggggggaggaagatagagaaataatgttatttaggaagaagcaaatggagtaaggaagcccaggctgtatcactgtaaagtctcttctctggaatcatctaccaccaccacaaccacccttgaatccaccaagagcagcacaagttaaaaaagttgggctttggggagctaagctattaaagtgcaaaggcataagaagaaggctgggctcagtggttctagcctggattcctagcagaaaccactgctcaaggaaatcagacaggaaataaaaaatggacaaacattccatgctcatggatagaaaaaaatcaatattgtgaaaatggccatactgcccagagtaatttatagattcaatgctattcccattaaactaccattgatattcttcattaaattagaagaaaactattttaaaattcatatggaaccaaagaagagtctgaatagccaaggaaatcctatgcaaaaagaacaaagctgaaggcatcatgttaccagatttcaaactgtgctacaaggctgcaataaccaaaacagcatggcactagtacaagaacagacacatagaacaatggaacagaatagagaactcagaaataagaccacacagctacaaccatctgatctttgacaaacctgacaaaaaaaaaagcaatgggaaaaggattccctatttagtaaatggtgctgggagaattggctagccatgtgcagaaaattgacactggactctttccctatacctcatacaagaattaactcaagatgtattaaagatttaaatgtaaaacccaaaactataaaaaccctagaagaaaatctaggcaataccattcaggatttaggcatggacaaagatctcatggtgaaattgccaaaagcaattgctacaaaaataaataaatagcaaaattaaaaaagcaattgcaacaaaagcaaaaattgacaaatgagatctaattaaactaaagagcttctgcacagcaaaaaaaaaactatcatcagactgaacaggcaacttacaaaaatggagtaaatttttgcaatctatccatctgacaaagtcctaatatcaagaatctacaaagaatttaaacaaacttacaagaaaaaaacaaacaatcccattaaaaagtgggcaaaggacatgaacagatacttctcaaaagaagataaaatatgcagccaacaaacatatgtaaaaaagctcaacatcactgatcattagagaaatgaaaatcaaaaccacagtgagataccatctcatgctagttggaatggcgatgctggagaggttgcagaaaaataagaatgcttttacactgttggtgggaattcagttagctgaaccattatggaagacagtgtggtaatttctcaaagacctagagacagaaataccatttgacccagaaatcccattactgggtatatacccaaaggaatataaatcattctattataaagatccatgcatgcatatgttcactgcagcactgtttcaaggaattatttattttcattcttaatttcttccttcacccattcaggagtatgttgtttaattttcatgagtttgcatagtttcaaatgttcctcttgttattgatgtctagttttattcattttggtcatataagatacatgatatgatttcaattttttttattatactttaagttctagggtacatgtgcacaacgtgcaggtttgttacgtatgtatacatgtgccatgttggtgtgctgtacccattaactcttcatttacattaggtatatctcctaatgctatccctcccccctccccccaccccacatcaagccccagtgtgtgatgttccccttcctgtgtccaagtgttctcattgttcaattcccacctatgagtgagaacatgcggtgtttggttttttgtccttgtgatagtttgctgagaatgatggtttccagcttcatccatgtccctacaaaggacatgaactcatcattttttatggctgcatagtattccatggtgtatatgtgccacactttcctaatccagtctatcattgttggacgtttggcttggttccaagtctttgctattgtgagtagtgccgcaataaacctacgtgtgcatgtgtctttatagcagcatgatttatattcctttgggtatatacccagtaatgggatggctaggtcaaatggtatttctagttctagatccctgaggaatcgccacactgtcttccacaatggttgaactagtttacagtcccaccaacagtgtaaaagtgttcctatttctccacatcctctccagcacccgttgtttcctgactttttaatggtcgccattctaactagtgtgagatgatatctcactgtggttttgatttgcatttctctgatggccagtgatgattagcattttttcatgtgtctgttggctgcataaatgtcttcttttgagaagtgtctgttcatatccttcgcccactttttgatgggtttttttttcttgtaaatttgtttgagttctttgtagattctggatattagccctttgtcagatgagtactttttgttacttgtttcatgtcctaacatatgatcagtcctgaagaatgttccacatgccaaagaaaagaatgtgtatcattcagttacaggatgaaatgttctgtaaatgtctgttaggttcatttggtctatggtacagttttaaaccaaagtttttttgttgattctctgtttagatatctgtccaatgctgaaagtggggtgttgaaatccccagtgattattgtattggggtctatccccttagatctaataatatttgccttatgagtgttgtggtattgggtgcatatacaattattttatcttactaaattgattcctttactattatataatgtccttctttgtctacagatttttacttgaagtctgttttatctaagtagagctattccttgcttttgtttcccttggcatggattatctttttccattccttcacttcagtctatgtgtgtctttacagctgaggtgagtttcttgtgggcatcatatagttgggttttgttttttatccattcaactagtctaaaccttttaaatggggaaattaattaatttacactcaaggttattattgataggtgaggacttactcatcttttttttgttgttttctagttctttttttttttttttttcttgagacggagtctcactccatcaccaggctggagtgcagtggcacgatctcagctcactgcaacctccgcttcccaggttcaagcaattctcctgcctcagcctcctgagtagccgggattacaggcacgtgccaccacacccagctaatttttctatttttagtagagactgggtttcaccatgttggtcaggcttgtctcgatctcgtgacctcgtgatccacccgccttggcctcccaaagtgctgggattacaggcatgagccaccgcgcccagcctttctggttcttttatagttcctttgttccttactttctctcttattatttttgcaggtaggtggttttctgtagtggtaagatttgattctctttttcctttgtgtattggctcttctagtgagttttatcattttatgttttcatgatggtggctattgtcttttcacttccagatataagactcccttgagcagttcatgtaagaccagtctagtagtaatgaattcttagtttttgtttgtctgtgtaagatcttatttctttttttttttttttttttttttttttttgagacagagtcttgctctgtcgcccaggctggagtgcagtggggcgatctcagctcattgcaagctctgcctcccaggttcacaccattctcctgcctcagcctcctgagtagctgggactacaggcgcccgccacaatgcccacctaattttttgtatttttagtagagatggggtttcaccgtgttagccaggatggtcttgaagatcttatttcttcttcatttttttttttgacaggctctcattctgttacctagtctggagtgcactggcacaatcatggctcactatagcctcaacctcccagactcaaccaaatctctcaccttcttttggctagctgggactacaggcacacaccatcatgcccagataattttttatattttggtagagacagggtctcactatgttgcctaggctggtcttgaactcctgggctcaagtgatcctcccacctcagcctcccaaattactgggattacaggcatgaaccacgacattcagcctctccttcatttctgaaggataatgttgctgggtatgatattcttaattggcagagttttatttttatttcagtactttaaatatgtcataccattttctcctgacctgtaaggtttatgctgagaaatatgatagtctaatggagattcatagctaatggtaattcccctatatgtgacttaatgcttttctcttgctgcttttaaaattctttctttgtctttgacttttgacaagttaactataatgtgcctcagagaggacctgtttgggctgaatcaatctggggttctttgagcttcctggacctgaatgtccatctctcccaagacttgggaagtcttctgacattattttattaaatatgttttccttaccttttccctttcttctctttctggaacacccataatatgcatattgtgcacttaatggaaaatggaattccacaaatcctgtaggctttcttcattctttttttctcttttcttttttaatctgcctatgttatttcaaaagtcctgtcttcaagttcagaaattcttttcttctgcttgggctagtctgttgttgaagctctcaattgtgttttttatttcattcattgaattcttcagctctaaggtttgtttggctctctttatgatatctatctcttcattgaatttctcattcaaataatgaattctgttcctaattttgttgactcatctatctgcattctcttatatctcactgagtttccttaagattattatttttaattcttttttagcatgtcatatatttccttatgcttagggtctgttatggaagaattattgttttccttttgaggtaacatgtttccttggtttttcatggttgatgtgtccctacattgatttctatatatctggtagaaaagttgcctcttacaattttatagagtaggttttgtaaggaaagacttattcattttcataggtattgactcagtggagttcattggccttggttctaggtggatgcagtagtatagtatccatttagtttcttctaccttagtccacactaatagtgtttgtgaatttctcagcggcctaggctaagagagtttgtgataatagtagtgaactttgccagaaatgggctttctaggcttttctcaggtggggagtgcatgtgtgtttctcaggtgggtcagccaaattggggttggggccacagagctgttattctggctgggagcactggcatgcagttgctcagtcaatctggacgtgtgtctgccaggagcaacccacagggctgtttctcaagcccagcatatgggtgtacagctgcttgtaaaggagtctttactaaaagaacaaatcacctagctgacctatggagtgattcccttcaagcatggtaacaaatcagtgtcttagcaaactagatagtcagaaggtggaagtccctcttgttaaacttatacaaaatttacagcctaaaattccttgaaacaaattttccaatctttcttcttcaaaatactttatgacatgggcagacccttatccactgcccaaaaatctgttgcccccaccacatgaaatgaatgaggacaagttcatttgggcttgtttgggctgttataacaaaattcagtagattggatggcttataggcaatagaaatttctcacagttctgaagactgagaagtctaagatctaagatctaggtctaagtataaaatcaaggtaccagcagatttgagatctggtaagaccagaactatttcttagttcataaatgataacttctccctgtgctctcacatggtagaaggggtaaacaagctcacttaggctcattttagaagggcactaatcccattacttagggctctgacctcatgacataatcacctcccaaaaagtcccatctcctaatactatcaccttggagttaggatttcaacatatgtatttgagggtatatgaacattcagagcatcgaactaagagtataaagtttaaatgttctcaccacaaaaaaactacatgaggtgatagatatgttaattattttgaccatagtaatcactttgcaatgtgtatatgtatgcatgtgtgtatatagtatatatatatatacacacatatatattaaaacattacattgtacacctcaaatatatacaatttttatttgtcaattatacttcaatacagttgggggaattaaaaaataaagtttcaagagaaaaaagaatttatctacttaatacaaaaccatgagtagtatacaaaaggttccaggtaccagtcataaataacaattttaaaatggctcaacaccctttcatgataaaaaaaaactctcaacaaattgggtgtaaaaggaatatatctcaacacaataacggccatatatgacaagtcctcaggaaacattatactaaacagtgaaaaattgaaagcctttcctctgaaatccagaacaagacaaggatgtccattcttcctacttctattcaacatattattgaaagtcccagccagagcaattagtcaagagggaaaaaagggcatcaaataagaaaggaacaagtaaaattgttggtatttgctgattacacaatcttatatatagaaaaccctaaagattccaccaaaaaactgttagaactaataaatgaatatggtaaagttgtaggatacaaaatcaacacaaaaagatcattagcatttctatacactaataatgaactatccaaaagagaaaacaaaagaacaatcccatttataatagctactaaagaataaaataatcagaaataaatataaacaaggagataaaagacctgtacatggaaccctataaaacattaatgaaagaaattaaagaagacacaaataaatggaaagatatcccatgtttatgggatggaagaattaatatcgtggaaatattcatctacccaaagcaatttacatagtcattgccatctctatcaaaatcccaatgtcattcttcacataaataagaaaaaaatcccaaattcatatggaaccacaaaaaaaatagccaaggcaatcatgagggaaaaaaaaaaaaaaaacgtagaggcatcatactactaatttcaaactatactacaaagtgataaaaatggcactgacataaaaatagacacattgaccaatagaataaagagtgcagaaatgaactcatacatatacagtcatttgacattcaacaaaggtgccaaaaatacacaataggaaaaggaaagtctctccaataaatggtgttgggaaaattggatatccaaatgtagaagaatgaaattggacccttatctcacaccatatacaaaaatgaactaaaatgggttaaagacttatacacataatgggaggcagaggttgcagtgagctgagatcatgccactgcactctggcctgggcaacaaaagcaaaactctgtctcaaaaaaaaaaaaagacttacacagaagacctgaaactgtaaaactactacaagaaaacagaggggaaaaaaactacaggacattggtctgggcaatgatttttcagatttggcctcaaaagcacaggcaacaaaagcaaaaatagacaaatgggattacattaaactaagaagcttctgcacaataaaggaaacaactaacagagtgaacagatgctctacagtttcggagaaaatacctgcaagccatgtatttcatagggggctaatattcaaaatacataaggaattcaaacaactctttagcaagaaaacaaccccatttaaaaaatggacaagggacctgaatgtttctcaaaagaagacacacacatggccaacagatatacaaaaaaaaagctcaatgttcctaaccattagaaaaatgcaaattaaaaccacaatgagtatcatcttgagaggtgacaacatgctggtggccctcgctcgctctcagtgctatcttggcctcggtgtctgttctggctgtgcttgagaagcccttcagcctgcagctgcactgtgggagcctctctctgggatggccgaggctggggctggctccctctgcttgcggggtggtgtggagggagaggcacgggcaggaaccagggctgcatgtggcactcgtgggccagcgtgagttccgagtgggtgtgggctcagcaggccctgcacttggagtggccggccggcaccgccggccctgggcaatgaggggcttagcacctgggccagcagctgcagaaggtgtgccgggtcccccagcgctgccgacccacctccgctgcactcaaattctcgctgggcctcggccgcctccccatggggcagggcttgggacctgcagcccaccatgcctaagcccccgacagtgggctcccacatagccggagcctccctgatgggcaccgccccctgctccatggctcccggtcccatcgactgcccaagggctgaggagtgcgggcgcatggcgcgggaccggcaggcagctccacctgcggccccagagcgggacccactgggtgaaaccagctgcactcctgagtctagtggggacttggagatcctttatgtctagctaggggattgtaaacacaccaatcagcactctgtgtctagctcagggtttgtggatgcaccaatcggcactctctatctagctaatctggtggggacttggataacctttatgtctagctaagggattgtgaatacaccaatcagcactctgtatctagctcaaggtttgtaaatgcaccaatcagcactgtgtgtctagctcagagtttgtaaatacaccaatcagcactctgtatctagctaatctagtggggacatggagaacttttgtgtctagctcagggattgtaaatacaccaatcagcaccctgtcaaaatggaccaatcagctctgtttaaaacagaccaatcggctctctgtaaaatggaccaatcagcaggatgtgggtggggccagataagagaataaaagcaggctgctggagccagcagtggcaaccggctcaggtccccttccacactgtggaagctttgttctttcactctttgcaataaatcttgctactgctcactgtttggtccacactgcctttatgagctgtaacactcaccacaaaggtctatagattcactcctgatgccatcgagaccacgaacctaccgggaggaatgaacaactccagacatgccgccttaagagctgtaaccctcaccacaaaggtctgcagcttcactcctaagccagcgagaccacaaacccaccagaaggaagaaactccaaacacatccaaacatcagaaggaacgaactctggacatgccgcctttaagaactgtgacagtcaggccaggcgttgtggctcatgcctgtaatcccagcactttgggaggccaacgtgggtggatcaagaggtcaggagatcaagaacatcctggctaacacagtggaaccccatctctactaaaaatagaaaaaaattagctaggcgtggtggcacacacctgtagtcccagctactcgggaggctgagacaggagaatcgcttgaacccagaaggcagaggtggcagtgagccgagatcgcgccactgtactccatcctgggtgacagagcgagactctgtctcaaaaaaaaagaactgtaacagtcaccgcgagggtctgcggcttcattcttaaagtcagtgagaccaagaacccaccaattccggacacaatctcacacctgtcagaatggccattgtcaaaaaaatgaaaaatatcaagtgttggcaggatgcggagaaaaggaaacccttgtacactgttaacaggaatgtaaattagtacagacattatggacaacattatagaggcacctcaaaaaattagaatagaattaacctatgacccagcaatcccacttctgggtatttactcaaaagattgaaaccagtatgttgaagagatgtctgcactcctatgttcattgcatcgactattcacaatagccaagttgtggaatcagcctaactttccatcaacaaatgaatggataaagaaaatgtgtgtttagttatgtacaatggaatactattcagcccttaaaaagaaattcatcctgctcaacctggtcctaatgctgccctggctgctcagctgacctccttttaccttctgatacctggatatccctctcctgttcagccccacagttcccaacaatttggttcctgctccatgatcagcattttcaataaaccagacactccagagaaaaaaaaaaaaagaaagaaattcagtcagttgtgacaacatgggtgaaactgaagaacattatcctaaattaaaataagtctacacagaaagacaaataccatatgttctcacttacatgtagaatctaaaacaatcaaactcatagaagcagaattagaatggtggttaccagaggctggagtgttgggggaaatggggagatgattgtaaagggtacaaagcctcagactagaaggataagattttttcaagatctattaacacaatgtggtgaatatagttaataatagtatattgtgcacttcaaaatcactaagagtagatttcaaatgttctcaccacaaaaaaataagtatttgagattatgaatatgttaatttggttgatttgattattccaatcaaatcataaattataacatcactttgtaccccataaatatatacaacaagctcgacacagtggctcctgcccataaccccagcactttggaagactgaggcaggaggattgcttgagcccaggagttcaagaccagcctgggcaacatagtgagacattgtctctacaaaaaaaaaaaaaaaaaaaaaacacaaaattagtcgggtgtggtggtgcccacctgtaattccagctactcaggaggctgaggggggaggattgcttgagcccaggagatcgaggctagtgtgagccaagatcatgccactgcactccagcctgggtgacagagcaagaccccaagtcaaaaaaaaacctatatatagttatagtttacaaaactatatatatagttatatatagttatagtttacaaaactatatatagttatatatatagttatagtttacaaaactatatatagttatatatagttatagtttacaaaactatatatagttatatatatagttatagtttacaaaactatatatagttatatatatagtttacaaaactgtatatatagttatatatagtttacaaaactgtatatatagttatatatagtttacaaaattgtatatatagttatatatatggtttacaaaactatatatagttatatatatggtttacaaaactgtatatatagttatatatatggtttacaaaactgtatatatagttatatatatggtttacaaaactatatatgtaacatatacaagttatagttgcatatatatatatagatacacacacaactataacttgtcgaaaatgaattttttttaaaaagcccaaaaaatggctcaatataaacaaatcccagtgtagaaaatgcctcagttccccgagatttacaataatgatcacagcccccaactgtcccatccttaattttctcaagtttatatgtttaggcaacttagggcactatgaatgggaaggacaattctacaaggaaaagttggaatgctattattagatgtgaaatatactgatgagcagacctaaacaactgctgttcactacctcccaacccttgactattccatgcatatactctctcctttctgttcataaatatgtttaatgccttggtctaacatcacaaaaagtacttacctactccttaaagggagacaatcgaaagtcagctccgactccttcaactggctacaagtataaaatctctaaatgagctctatctgtatattaccaataaatactgtgaaaaaagtggttaattatatcataaaccaacataccctatataaaacaataaaagaaataaaaaataaatgcttgaaaaatattaatgctacaacacaatgattaggaaaatacaggtagctttatttgtgctgttcattataagcccgtaatagctgacttgcgttaacaatcctcctctattatgcatttcatacttttgtgtttagccaataccacaaataagctgtgttctttatgtaaaacttcatttctgtgtgatattagcttttgagagaactgcctgggcaggctttacattttcccatcttttggactttaatggctcccattatattttacaactgagatggggtacaattatatgtatatatttttcaaggtagctaaggtgaaaattaaccctattttatcttcacagtttcaaaaattgcaggcaaactgtaatacccatcttttgtcaatttttttattcttatgaagagactgaagtggccagatataaatgtcaactctgaattgaacaggtccattttttaattgcttgatgaaagtattcccccatttagacacaaaaacaatcaaaccagtagagtgcataatcataagaatgggaagcaaaactattacaaagtagaatcttaaatactacctacaccaacttggtccccaaacctatgtgttttgacgatgctacaaagaacataagctcagggcttatactgcatacagcaagggaaatccccagccttgaaacatagttgcatcttcaactttataagacaatatgcctctagagatggtaatacactaggtaagtagatacataagcactaatatattttcttacttcttgtagtgggaagtaagttcctaaaacaggcaggaacaatatagtattatttgctaagatgaccataaggtattggacaagcccatcaaagctgatattaacaagatatggtggatgaaaaaagcaaatctaatgggatgattacaaaattctaggtcaggcacggtggcttatgcctgtaatcccagcactctgggaggctgaggcgagcagattgcttgagtccaggagtttgagaccagcctgagcaacatagtgaaatccatccctactaaaaatacaaaattatccaggcatggtggcacatgcttgtaatcccagctactcagaaggctgaggtgggagaatcacctgagcgggggagatcaaacctgcagtaagctgggatcacaccactacattccagcctgggcaaccagagtgagatcctgtgtttaaaaaaaaaaaaagtataggctgggcatggtggctcacacacataatttcagcactttgggaggctgagacaagaggatcacttgagctcaggtggtcaaaactgcagtgagtcatgactgcaccactgcagtctagcctaggtgacagagcaagaccctgtctcaaaaaaaaaacctgaaaaacatgacattttggaccaggtaatttttttttcaagttctgaagatgaacagtggtaaggaatccacaacaatgtgaatgtacttaatgtcactgaaatgtacactttaaaatggttaaaatggtaaatttggccaggtgtggtggctcacgcctgtaatcctagcactttgggaggctgaggatggcgatcacctgaggtccagagttcaagaccaatctggcctacatggtgaaaccccatctctactaaaaattgggtgggtgtcatggcacacacctgtaatcccagctacttgggacactgaggcaggagaatcacttgagcctgggaggcaaaggttgcagtgagctgagatggcaccactgcactccagcctgggtaacagaatgagacgctgtctaaataaataaataaataggtaaactttatgtgatgtatatttaagtacaataaaaaaccgagtctaagttcattataacagcatagtaatgaggaaaaatgtcccaaatgatctatttggttcttttgtaacatgggactaaattagtatcataccaacaaggacacttaaaagttgaaagtcacttgggttaaatttatgcacagtttctgtgtctaagactatggctatatcaagcccattacttggttaatggactgcctgagcaagaagatagatggaatttacagagtgacatatctggtccatctgattattaaggatatcttctatactgaggacccctgataaacagttacatgaaacatgaataatctcacattatagatccatttattcaacaaattttttttttttagatggagtcttgctctgtcaccaggctggagta[137 bp omitted]ggtttcaccctgttggccgggatggtctcgatctcccgacctcgtgatccacccatgtcggcctcccaaagtgctgggattacaggcgtgagtcaccgcgcccggcccaacaaattattctgtgtgtgtgtgtgtgtgtgtgtgtgtgtgtgtgtgtgtgtgtgtagacagggtttcactatgttgcccaggttggtctcctacccctgggcttaagacatcctcctgcttcagcctcccaaagtgctggtattataagcgtgagccattgcacccagctgtcaataaattattcttgacaaattaatatgtcataatagaatttccattcacattgtccttctctaaaacttgttctcaccaactttctagtcttacttattccgctacccttgcaatacaaggtcattccaaccactcccaaatccatgaattaggctatctttgcttgcaggtaaaatagacaagaatgcattttcctcaagttctgcctactgggaaatttttcattccccgctgtccttcagggcaaatgagttaaagcagcttgtttacaattagtcctaaaacacatttcactggagaacttgcgcaaaccaggcaacaatttttccaacattagacatctggtcttcaggaattctcaaagaagccataagtgtggatttcaaattctgtgacaacacaacaaaaacgggatatttcatgggctgggaatataatctacttgctcataaaacttacttgcacctttagggccatagtatacctggtaaaatgtagagtcctttttttttttttttttaatgaactgcttatgggttcaatgggtactccaagattttctcaagcatctttccttcacaggcctttaccaaacaaacaggaagttaatgatcctcactgttttccatctcataacattttcactcaatgtcttaaggcccacactctcgaatggaacatatcatctctccctggggacatgcagctcaaaatattcactcccacactcacacatgatcatacaggcacttcaggaacccaacatttaaataatactgtcattaggaagccctccttctcaacacacacgggcagaacacaaggcatctggcacttgggaacatatttatcccgccattgtagcctagggtctttgccactcaaccctgccaccacccagccttatcttaattggaacaatgaagctggtgatatggaggagcaaaaacattagctttgttggaaacatggaaccagcaccttcagattccttttactcaaagctctggtcctaacctttctccacactgtggggaatgtagtcttgccaacaccagacagttagcctctacccattgactataaaatcagatttcaactcttttatacaacttctttatgaaaaccttgaaaaaaagaatcgtatcttatttggctccctttaacaatatattatacaacagagaaactaaatatctgtatattgattatgctaacatgcaggacaggatcaaaactaacacaatagaattcaaatatgcaaaatcattcagagttattggaaaggtaaaaatgcaagtttaacattttttcaaagataatgtcctggctatatctatattgaggttccctacatttggtgctacatagaatttatgttattaatcttatggagctatagtgtcaggatatataacagaattgatactttatttatactagctggaccttttaaataccttctcatttataatgcccaaatggaaaataataatttatttccttagcaaggcaaatcttcacactaataagagaattgaattaagatttgcccaatatgaaccaaaatccttgaacattaaaaccctggattccctcactcttttttttttttttttttttttttgagacagagtctcactctgtcgcccaggctggagtgcagtggcaccacctcggctcactgcaagctccacctcccgggttcacgtcattctcctacctcagcctcccgagtagctgggactacaggtgcccgccatcacgcctggctaattttttgtgtttttagtagagacggggtttcaccttgttagccaggatggtctcaatctcctgaccttgtgatccgcccaccttggcctcccaaagtactgggattacaggcgtaagccaccgtgcctggcctccctcactcttacccaaatactcacagctcccaatcctcccattcatgagttgtttctgtctacactcatgagaaataatggacactgtgactgagagtccattacatgaaagggcagttctacaaagaaaaattaggatgctggctggccatggtggctcatgcctgtaatcccagcactatgggattacaaagcgggtggatcacctgaggtcaggagttcgaaaccagcctggccaacgtagtgaaacctcatctctactaaaaatacaaaaaattagccaggtgtggttgtgggtgcctgtaatcctagctacttgggaggctgaggcaggagaattgcttgaacacaggcagcagaggttgtagtaagccgagatagcgccattgcactccagccttggcaatagagtgagattccatctctaaaaacatatatatacacacatatatatatacatatacatacatatatgtgtgtacatatacatacatatatgtgtgtacatatacatacatatatgtgtgtatatatacatacatatatatgtgtatatatatacatatatacacatatacatatgtatatgtgtatatatatacatgtatatatgtgtgtgtatatgattgatatttaaattagtagactgagtaaaagagattacccttcatgatgcaggtgggcctcatccaatcagttgaaagccttaagaggaaataggctgaggtcccacagaggaaggaggtattctgactccagactgcctttgaactcaaaactgcaacatcaacacattcctgaacctccagcctgccagcatgccctgcaaatttcagatttgtccatccctacaatcacacaagccaattccctaacattggttttgtttcattgattctgttcctctggagtaccctaatacatagactttaaaacaaaaattataactagaagtacattttacaaaaagaaaagacagatttactcagcatcattatcagactatgacatttagcaatcaacagcatgggtgcaaaaaaaaaatctactttaaaaccctttgttggaatgctttatactttccacagaactgaaactaaaataacatgttattcaattagtcacaaatatagtccttgagttttttgcctatacacatgaatatttgtctaaagcatgtcttctttgtagcagctaggccctgccaccactgtgcttggctgcattcacaaatctgttgtaacctgtagcttccctgtcacttctctggctctcctctcctgctaagctttgtttcccggcagtaattaaaatcttctgccactgccatagctactactgctactggaacctccatggccaccttggttttgtggtttggcaaagtattgtcctccaccaccataggggtcagagcttctgcctccaaagttgcctcccttcatgattccaaaatttgaagactgatttttgtaattgtcaaaatcattgtagcttccactacctccaaaattacttccatcattaccaaatgcattatagccattcccactgccaccatatccaccaccaccatggctgccaccaaagccaccacaaccactgaagtttcctccacgaccaaaattgtcattcccactgaagccacctccaggaccaccaccaaaatttccagaaccacttcgaactctttggctagatgaagtactacccatctcttgcttcgactgggctttcgtaacttctaagctgtggctattcacagtattgtaattttttttttttttaagatggagtctcactctgtcacctaggctggagtgcagtggcatgatctctgctcactgcagcctctgtctcccaggttccagcgattctactgcctcaggctcccaagtagccaggattacaggcacacaccaccatgcccagctaatttttgtatttttagtagagacggggtttcaccatgttggctaggttggtcttgaactcctggcctcaagtgatctgcctgcctccccctcccaaagtgctgggattacaggtgtgagccactgcacccagtcaagcatgtttctaagaaaagggcaaacaattctcaaagaggcccctaatatctaaaaccagtttagaatccctgccctaggtgaatacaggaaacattgtcaaaactaaaaggaaacttgtagggcatcttaatcaatcagccaagatgggtgccaaagcccaaagccaggtagaggcttgtgcaagatcacaagcagaggcgcagtttgaagctagattctcccactcttaaactagtgctggacagactgaggcctagcaagttggctacagagccctagcagattcctgtctccacactgagccaggaggggttgctgcccagggataccgacagccatacttaagctggacaaggcacatgctcttggtggaagcaaacacgtccgctacctcatacagaaataaaaatgattataaaggaatcctgggaatatctgtatgctaaaaaattagataacttagatgaaatgaacgaattcttaaaaagataacaactaccaaaactgacttaaaataaatgggaaatctgaatagatctgtaaagagtagacaccaaatcactaatcaaaaaatattccacaaaggaaatcccaagctcagatgatttcaatggagaactctaccaaacttttacagaattaactctaatcatttacaaactcttccaaaatatagaagaggatggaatactttccaactcattctatgaggccagtactacagacaaagatatcataaaaaagaaaactacagaccaatagtccctatgaatataggcacaaaaattctcaaaaaatattagtaaaaagattcagccacatataaaaaaagattatatgccataatgaaatccaatggaatttgtcccaagaatgccaggttattcaagcatgcaaaaatcaatgtaatataccactttaacagagcaaagggcataaccaacataatcaactcaatagacacagaaaaaaaaattgacaaaaatctgtcaaccttttatgataaaaacactcctcaaattaagaatagaacttcctcaacctaaaaaagcacatttatgaaaaatcccgagataacatcatacttaatgggagaaattaaaaagttttcctttaagatcaggagcaagactatttcctggtaaatttttcctctcctccgtgtttgagttctatccatttcacatttctattaccgaacgtgtttatttcttctatgttttttccagccattattggcagttttgtctattttaatggtatttttaaaatacaaacttttagttttatttggcaattttagtgtttctttttttctaattcactaatttcaactactttcttcaattatcctctactttctctttacttactttgctgttttgttccagtttcttaggttcaagccttagttaatttgctttcaagtattcacatgtatatattaaagcattggtaagaatttatttacaactgttcattatagagatgttgatgtcccgagcaatagtggtcatgatccctagatgtggaggaaagaaggggggaaggctgaggttaatcagtagggttctggtaaagcatggtctttcaagctacatggctgggtacccaagaacttaactgttctgctcacaaggctgattctggatgcaccagaactctgcccaggcttaagccctggaaagataaaaatcagagatatgaattcaactcctcacatgagaaggacagctaacccttcagatatttcagtcaagtccgggattcttctatctgctgtctgcaacatcatgaagcctgaatgggctcacttttctctatggctcctcatcttgtccatgcttctccacacaccttcagggaacatatttcctccacaactcagaaaacagttacgtgaaagtggacatcttggaggtaaagaaaaacagaaagggcagaccaatgtgacactgtgaaggagagggaggtctgggcagcctgggtgatgttgctgccagtaattagaatcaagtctcctttttatctcaaaccgtatggctctaggacatctgattcagagaattacattgagtttcctctatggagtggagaaggaggaagacagaaagcagaatcaacttaagttttaaccatgagatttcagtataagagtgggggttatgaaaatgggattgatttcagaggtgtccaagaaattcctttgttggggtgtgtgtctgtacattagatgagttttgagtctattcaacacatatgtgtagaaccactatgttatattccactgatacagatatgcagaggccatcattcccccatatatgtatagagcactcctatcctacttatttaaattaatttgttcttcattcaaattaacatgagcatctgtgaaacactcaaggcaaaaggggcaagttcccaatcatggataagaattgcagttgggcggccaggcgcagtagctcacccttgtaatcccagcactttgggaggccaaggcaggcggatcacctgaggtcaggagtttgagaacagcctgtccaatgtggcgaaaccccatctgtactaaaaatacaaaaattagccgggtgtggtggcgcatgcctgtagtcccagctacttgggaggctgaggcacaagaatcacttgaacccaggcagcagaggttgcagtgagagccgtgatagcgccactacactccctcctgggcaacagagcgaggctccatctcaattaaaaaaaaaatttaaaaaagaattgtagttgggcttcaagaagactaacattaactctttctctgtctccaactcagtcatcatggcttctgctctaaccacttaatctccatggtctcagtaaaaccaggtgagtctggatgggtaggcaaaagtggggctggataggagaggaaatagactgatggaggaaaggaagatctgccagagtggacattttaaacctgtccttcagagtaggtgtagtgggtgagaggtctttttagcttgtgtatttgcacagactctggcgggcagagaggagagagtgaaagtaagggctctgaactatgtccttgaggaagctgatgagttgttcacttccagtgacatgggaagcatgtggagtcaagaaatgggatatctttactgcgaaagatgaaggaaacctcaggtctttcttgttctcagctctaaaatagtataagaacctcattgtgcttctctatttctgtgtcatggacccagtctgtagtctggaacaatttccccatatgcttagggaactctgtcttgttccccaggggtaaaattagttagatttatgtgggttggaagttttagtagtctgagcctgtgagaacaagaatgccaaaagagtagtaaagaaaacctgactctggaattctcattcacagaatactgcaactatcctctgaagaagggcacctgtaattcatatttgaccagattctactacaacactttgacatttttatgtgagccctttgtcttcagtggctgtggaggcaacagaaacaactttaaacagaaatatttctgtgaaaaaatgtgtattactgaaaagtaagtctctggatatcttacccaaccctcaatgacaccaaacactagggatcaaagctttttaaggaaaaaggaaatgaaaggcaagggcaatgagcagggaggcaagaaattatacctaagttagggatagcctgtcataggtattaatttctcaggtcacttaaatgtcactataatcagtcataggcataagtttttcaggtaacttagtttaataacattcttgaaattgtgaaaattgaagttcagccaagcacagtggtgtgcacctgtagtcccagctacttgggaagctgaggcaagaagattacttgagcccagcattcaagaccagcctgggcaatacagcaagacttccatttagatagatagatagatagatagatagatagatagatagatagacagacagacagacagacagacagacagacagacagatagatatagatagccaggcgcggtggcttatgcctgtaatcccagcactttgggaggctgaggcgggcggatcatgaggtcagtagatcaagaccatcctggctaacatggtgaaaccccttccctactaaaaatacaaaaagttagctgggcacggtggcacacacctgtaattccagctactcaggaggctgaggcaggagaatcgcttgaacccaggaggcagaggttgcagtgagccaagatcatgccactgcactccatcctgggcaacaagaacgagactctgtctcaaaaaaataaaaataaaaataaaaataaagctcagagaggctactgatttgcccaaattcactcagaagaaggacatggatccagagctcctagctccccaccagcatctcagtactaccaggatggcatcagctttttgagattgtgttcaacatcttattgtttcacagttaaatggaaagctatgagaatgtcagaagagtaggagaagacaaggatcatggtttagtatccactataaagaatagctaaacaatggtcttacacgcaagagcagagatatcactttattcatctgtatattctcaaagtctagtactatgtttgcccattaatattttatggatagatgcatgggtcaggaggaatattagtattaaagagagctgtgaagttctgctgagatgttaaggacccattgtttgggtccttattgataccaatggccataataatctctaaatttatttattcattaacagggaccaaagtcaatagggccttaatatgacagaaggaggaaacaaggaaaaaggagtatgctctatgaaaaatcatgccaaagttattctgagaaaataaattggattatttctaaaagatttttgaattctgaattctttctaatttccttgcccaggtttacctttcatactaattagatatataaaactttaactgaaaattttctgtatgtcagctctggtctgaatttattcatctctcccattctagattcttccaacatatactgcaaatgacctctctgcagggaccaacctatccatgtaatgcatcagtgtatgtaaaggcaatcattattgatatctcctcggcatgacatgccaaaactgagtttctttctgtattttgtcactgacttcagtgggatttgcatgtaggtggcaccaagataatcattattaaattctttcacctgctccaaatcaaagggcattcaacccacaaaagtgatcatattctagggaaatatcttcagtgccctagctacaagccatatggaaattgtgactttacagctgagagctatgagtcttgaaccaaagtgaacctctactctcagagcatgaagggccactcccttcttctctgtcttattcatattcttgtcaaggactaagcctcacaaatgaatctattgatataaatagcttatgccagtgttctaagggccataaacagtagaataaactgaagctcagagtgaagccacttgtgggtattctagctcgatctcaacactggcaacccctaatcctgaattatgggcatatcctaggagaaatcatgggaattagcaaaaagtatgtgttaaagatgtcacctagttctgcttccaggaattactcctgtgcaaaaaagggacaaaggaaacaagaatgttctggtagcttctaggtattgaggcaaagtctagaatctcagaccatgctgtgtcttgggcctgaatgtcatggtgcctattcatggattctgaagattttccttcctctgattactgtaaaaaacagtgttacataaacaagattcaagtgcaattttttaagtctttcaaaactatagtctagtccaaagaattaatataagtaaaatattctctggagacaaagaattaccgacaatgatgacccaaagttcattctagcctcaagttttcagatttcttctgggcacttgagtaattgcccaagtttctttctcaatcaatcctatatttgcatctaagaaaaaggtatgtgtgtactgtctgtagtgctgaaggaatattttataattacccacaaagattagtaaaaaggcccaaagatatatgtgcattgcagaccttcatagaaaaccacatacccaaggactaatacaggacacaaatccacaagaaacccaagtggatttcacattaaattcaagtgagatattttgaggagaaagtcacagatagaagagtaacaaagataaaaatataaaccaaaacctcagagtacaaaccaaagacagaatgaaaagattttggttctgactctagcctcttcccctgagtcatatcttaccactggagaaactgaaaggaaaagatcccattacatatgagatggaaattaaaagtggtttaagaagattctgatttctcatttaaaaagccccaaagagtaggcgtagtgactcacgcctataatcccagaactttagggggtcaaggcaggaggatcacttgaggccaggagtttgagaccagcctgggcaacacagcaaaacttgtctattaaaaaaatacaaaagatggccaggcccgatggctcacacctgtaatcccagcactttgggaggccaaggtgggtggatcacctgaagtcaggaattcgagaccagcctggccaacgtggtgaaacccca[133 bp omitted]cactccagcctgggcaacaagagcgaaactccacctcaaaaaataataataataataataatacaaaaggccaggtccagtggctcatgcctgtaatcccagcactttgggaggccaaaacaggcggattgcttgagttcacaagttcaagaccagcctggacaacacggcaaaactccatctctacttaaaatacaaaattggcaaggcatggtggtacatgcctgtagtcccagctgcttgggaggctaaggtaggatgccggcctcagccaggagacagaggttgcatgagccgagatggcaccactgcactccagcctgggcgatagagccagatcttgtctcaaaaaaaaaaaaaaaaaggtggtggggagaagaaaaaaaattgtaatacaaaagataaacaaaacaaaaagttgtttttttggaaagataacaaaactggcaaacctttagctagactaaccaagaaaaaaatgaagaccaaataaataaaatcagggatgaaaaaggacacattacaactgataccgcagaaatacaaagaatcactagagactttttttttcccctgagatggagttttgctcttgttgcccaggctggagtgcaatggcacgatctcagctcactgcaacctccacctcccgggttcaagcgattctcctgccttagcctcctgagtagctgggattacaggcatgtgccaccacacccagctaattttatatttttagtagagacagggtttctccatgttggtcaggctggtcttgaactcccgacctcaggtgatccactcgcctcaggcttccaaagtgctaggattacaggcgtgagccaccgcatccggcctggatcattagaggctattatggaaaactacacaccaacaaattggaaaactaaaaagataaattatttgacacatacaacttaccaaaattgaatcataaagaaacagaaaacttaaacaggccaactatgagtaatgagatgaaagcagaaattaaacgtatctctttaaagaaaagcataggacctgatggttttactgctgaattctaccaaatatttgaagaagaattaatacaaattctactcaaattattctaaaaaattgaagagggaatacttccaaactcattctacaaggcaagaagtaccctgtggccaggcatggtggctcacgcctgtaatcccagcactttgggagactaagagaccaaggcaggtggatgacttgaggcgaggagttcaagaccagcctggccaacatggcgaaaccctgtctgtactaaaaatacaaaaattagccagggaggtggcgcatgcctgtaatcctagctactcaggaggccaaggcataaggatcgcttgaacccaggaggtggaggctgcaatgagccaagatcgtgccactacactccagcctgggcaacagggcgagactctgtctcaaaaaaaagatcattcaccatgatcaaatgggattcatccccagatgcaaggatagttcaacatatacaaatcaataagcgtaatacaccccatcgacagaatcaaaagagccatatgatcatttcagtagattgtgaaagagcatttgataaaattcaacatcccttcatgataaaattctcaagaaattggatatagaaagaacatacctcaatgcaataaaggccataagtgacaagcacatagctaataccatacggaatggggaaaaacggaaagccctttccactaaggtctgaaacaagataatgatgccactttcaccactgttattcaacatagtactagaaatcctagccagagcaattaggcaagagaaagaaataaagggcatccaaattggaaaggaagaagtcaaattagccttggaaacacatgacatgatcttatttttagaaaaacctaccccaccaaaaaattcttagaactaatcaacaaatttagtttaattgcaggatacaaaatctacatacaaaaatcagtagtgtttctatatgctaacaataatcaatctgaaaaagaaaccaataaagcaatctcctttacaatagctacaaaaaaaaaaaacctaggacaaaattaattagaagatctccacaaggaaaactataaaatactaatgaaagaaactgaagagtacaccaaaaaatggaaagatatcccatgctcataggtcagaagaattaatattgttaaaatgcccataatatccaaagtgaccttcagattcaatacaatctctattaaaatatcaatggcattcttcacataaacaggaaaaaaaaattctaaaatttgtatggaacgacaaaagaccccgaatagctaaagcaatcctgggcaaaaacaacaaagctggaggtatcacactacctgaattcaaattatacaacaaagctatagtaaccaaaacaaagctatagtaaccaaaacagcatggtattggcacaaaaacagacacatagaccaatggaacagaatagaaaacccagaaatcaatgcatgcacatatagacaactctttttttttttttttttttttttttgtgagacggagtcttgctcggtcaccctggctggagtgcagtggcgtgaactcagctcactgcaagctctgcctcccgggttcacgccattttcctgcctcagcctcctcagcagctgggactacaggcgcacgccgctatgcccggctaatttttttgagacaactcatttttgacaaaggtgccaagaacatatattggggaaaggacagtcttgttaataattggtgccgagaaagcgggatatctatatgcagaagaatgaaactagattgcaatcttttaccatatgcaaaaatcaaataaaaattgattaaatactgaaatctaatgcctgaaactacaaaactagaagaaaacattagtcaggacattggtcttgggaaagattttctgggtaagacctcaaaagcaaaagcaacagaagaaaaaacaaacaaatgggattacatcattaaaaagtttctacagccaggcgcggtgggtcacgcctgtaatctcagcactttgggaggctgaggcaggtggatcacctgaggtcaggagttcaagaccagcctggccaacatggtgaaacccc[132 bp omitted]attgcactccagactgggggaaaaaagcaagacttcatctcaaaaaaaaaaaaaaaaaaatttctgcatggcaaaggccagttgcctttaatcccctataatccccacactttggaggccaaggcaggcagatcacctgaacctgaggtggagagtttgagaccaatctgggcaacatggtgaaaccctgtctccactaaaaatataaaaatcagccagatgtggtggtgcacacctgtaatcccagctactcgggaggctgaggcacaagaatcacttgaacccaggaagtggaggtttcagtgagccatgattgcagcactgcattccagcatgggcgacagcgtgagaccctgtctcaaaaaagaaaagacaagctacaggatggaagaaaatatttccaaactacctcatcaacaagggactaggctatgcacagtggctcacacctataatcccagcactttgggagacagaggcagcaagatcacttgaggccaagaatttgagaccagtccgggcatcatagcaagactctgtctctacaaaaaaaaggcaacaacaggaattaaaaatatataagaaactcaaacaactcaataccaaaaaaaaaaaaaaaaaaaaatctggctggcacagtagttctcgcctgtagtcccagcacaaggccaaggcaggtggatcacttgaggccaggagtttgagaccagcctggccaacatggcgaaaccctgtctgtactaaaaatacaaaaattagccagatgtggtggtgcatgtctgtaatccctgctacttgggaggctgaggcaggagaatcatttgaacccaggaggcagagggcagagtttgcagtgagacgagactgggccactgcactccagtctgggcaacagagcaagactctgtgtcaaaaacatatatatatatatgcgtatatatacgcatatatatacatataagtatgcatatatatatgtgtatatatatgcatatgtatgtatatatatctgtatatatatgcatatgtatgtatatatatctgtatatatatgcatatatacatgtatatatatatctgtatatatatgcatatatacatgcatatatatgtgtatatacatacagatatatatatacacacacatatatacatatatctcaaataaagagacattcttgggcaaaggggatttgtcccagtggtcttgacagtgccacaaatcattttaacacttttgggtatagccagaaccatcctagtggtctgaaacacaaaagtgaggcccagactacttagggagatcaggctgggtgccagaaattaaaaggataggagccagagacaggtaagcagaaagtttacaagaaaaaaaaatggaagatgaacaaagaccctaggcctctgccaggtgggctgtgagagaagaggtttcaaaagaggaagaacttaagatgacattcttacagacagacccctggccattgcagaagcatttctgggctccttggcgccccccagtccaggaggcactgcaggacacaggaggccttggagctcatgggcaccagagcccaggcttccatgtagctgagatacgatctggcactgcagtcctcaaggtcttgcaggggccctctgacccccggttccagccctgggacacaattgccctgctacatgcttcctttctataattaaagaaggaaaccctcagggcaccccactccaccactcacctctcgccagggaccaggtaccagggtgggtgtcctcttcctgaaaaagaaaggcttagatgaagcagtcccttgtgaaacaggcagccattagcaccagggcccagcctaggtgagaactctcaggccctgcctggcagcccacagccaggcatggttgagataccaagttactctacagatgtctttgttttttgttttttttgagtcagagtctcactctgttgcccaggctggagtgcagtagcgtgatctcggctcaccgcaacctctgcctcccaggttcaagcaattctcctgcctcagcctccagagtagctggaattacaggcgcccaccaccaagcccagctaatttttgtgggggttttttggggtttttttgtttgtttgtttttgagacagagtctggctctgtcacccaggctggagtgcagtggcgcaatctcggctcactgcaagctccgcctcccggcttcacgccactctcctgcctcagcctcctgagtagctaagactacaggcacccaccaccacacctggctaattttttttttgtaatttttgtagagacagggtttcaccttgttagccaggatagtctcaatctcctgacctcgtgatccacccacctcagcctcccaaagtgctgggattacaggcttgagccaccgcacccggccaatttttgtatttttagtagagacggggtttcaccatgttggccaggctagtctcaaactcctgacctcaggtgatccacccgcctcagcctcccaaagtgctgggattacagacatgagccaccgtacccagcctgcatttttttttaagcattaggttggtgaaaaaatattttgattttttttaaaacaagcaagcattacttttgtgatcttttaaaactgattggatgaaaaaatggaaaatgtaacataagaagtgtcagacctctgagcccaagctaagccatcatatcccctgtgacctgcacatacacatccagatggccggttcctgccttaactgatgacattccaccacaaaagaagtgaaaatggcctgttcctgccttaactgatgacattgtcttgtgaaattccttttcctggctcatcctgtctcaaaaagctcccctactgagcaccttgtgacccaccccccaactctgccctccagagaacaactcccctttgactgtaattttcctttatctacccaaatcccataaaacggccccacccttatctcccttcactgactctcttttcagactcagcccgcctgcacccaggtgaaataaacagccacgttgctcacacaaagcctgtttggtggtctcttcacacggacgcgcatgaaatttggtgccgtgactcggattgggggacctcccttgggagatcaatcccctgtcctcctgctctttgctccgtgagaaagatccacctatgacctcaggtcctcagaccgaccagcccaagaaacatctcaccaattttaaattgggtaagcagcctctttttactctctcctccaacctccctcactatccctcaacctctttctcctttcaatcttggtgccacacttcaatctctcccttctcttaatttcaattcctttcattttctggtagagacaaaggagacacgttttatctgtggacccaaaactccggcgccggtcgcagactagggaaggcagccttcgcttggtgtttaatcattgcagggatgcctctctgattattcacccaggtttcagaggtgtcagaccacgcagggacacctgccttggtccttcacccttagtggcaagtcccgcttttctggggaagggtaagtaccccaacccattctctctgtgtctctacctcttctttgcctttctggggggcaagaaacccccaaccccttctccttcacccttagcggcaagtcctgcttttctaggggaggggcaagtaccccaaccccttatatctctgcaccccgatcccttatttccacgccccaaccccttatatctctgtgccccaatcccttatttccacgccccaaccccttatatctctgctccccgatcccttatttccgtaccccaacctcttatatctctgcacccgatcccttatttccacaccccaacctcttatatctctgtgccccgatcccttatttccacaccctgacctcgtatctctgtgccccaacccctttcccacttttctggagggtaagaacccccgaaccccttccctccgtgtctctactctctcttttctctgggcttgcctccttcactatgggcaacattccaccctccattcctcctcctccttctcccttcctgtgttcttaagaacttaaaacctctttaactttcacctgacctaaaatctaagcaccttattttcttctgcaacaccacttgaccccaatacaaacttgacaatggctctaaatggccagaaaacagcactttcgatttctccatcctacaagacctaaataatttttgtggaaaaatgggcatttttcacacttcgttccctccctagtctctgttcccaatacgattcctcccaaatcctccttctttccctcccgcctgtcccctcagtcccaaccccaagcgttgctgagtctttccagtcttccttttttctacagacccatctgacctttctcctcctccccaggctgctcgtcgccaggccaagctaagtcccaattcttcctcagcctccgctcctccacactataatccttctaccacctcccctcctcacacccggtccagcttacagtttagttctgcaactaattcttccccacctgcccagcaatttcctcttagagaggtggctggagctgaaggcatagtcagggtacatgtacctttttctctatcagacctctctcagatcagtcagcatttaggctctttctcatcagaccccactaaacatatacaggaattccaatatctaactctgtcctacaatttaacctgaagtgacttaaatgtcatcctgacttctaccctctccccagatgaacaggaaagagttttttctctagcccaatttcacactgataaccgccggcttcgtgaacctgacctccaggaaggcagtagagcagttccccgagaggacccccaatggaactataaggcagattccccaggtacagctaggcgagattacatggtttcctgcctagttgaagggcttaaaaaggcagcttacaaagctgttaattatgacaagcttaaagaaactacccgaggtaaagatgaaaacccagcccaggtcgtggcccgcttagcagcaacccttacacactttaccgccctagacccagaggggccagaaggccgccttattcttaatatgcattttatcacccaatccactcctgacattaggaaaaaacttcgaaaattagaatcgggccctcaaaccccacaacaggaattaatcaacctcgccttcaaggtgtacagtaatagagaggaagcagccagacggcaacgcatttctgagttacaattacttgcctctgctgtgagacaaaacccagccacacctccagcacacaagaacttcaaaatgcctaagccgcagcagacaagcattcctacaagacttcctccatcaggatcttgcttcaagtgccagaaatctggccactgggccaaggaatgcccgcagcccaggattcctcccaagctatgtcctatctgtgcagggacccactagaaggcagactgcccagctcgcccggcagccactcctagagcccctaaagctctagcccaaggctctctgaccgactccttctcagatctgctcggcttagcgactgaagattgacgctgcccgatcacctcggaagccccccggaccatcatggacgccaagcttcaggtaactctcacagtggagggtaagtccatcccctgtttaatcgatacgggggctacccactccacgttaccttcttttcaagggcctgtttccctcaccccgataactgttgtgggtattgacggccaagcttcaaaaccccttaaaactcccccactctggtcccaacttggacaacactcttttattcactcttttttagtcatccccacctgcccagttcccttattaggctgagatattttaaccaaattatctgcttccctgactattcctggactacagccacatctcattgccacccttctccccaacccaaagcctccttcgcgtcttcctcttgtatcccaccttaatccacaagtatgggacatctctactccttacctggcaaccaatcacatgcccattaccatcccattaaaacctaatcacccttaccctgctcaatgccaatatcccatcccacagcacactttaaaaggattaaagcctgttatcactcgcctgctacagcatgggcttctaaaacctataaactctccttacaattccccattttacctgtccaaaaaccggacaagtcttacagattagttcactattcccctgcacccctcgtcccagcctctctttgctttcacttagactgaccctgacacccattaggctcagcaaattacctgggctatactgctgcaaggcttcacagacagcccccattacttcagtcaagcccaaatctcatcctcatctgttacctatctcggcataattctcataaaaacacatgtgctttccctgctgatcatgtccgattaatctcccaaacctcaatcccttacaaaacaactcctttccttcctaggcatggttagtgcagtcagaattcttacacaagagccaggaccgcaccctgtagcctttctgtgcaaacaacttgaccttactgttttagcctggccctcatgtctgcgtgcagcggctgccgctgctttaatacttttagaggccctaaaaatcacaaactatgctcagctcactctctacacctctcataacttccagaattattttctttctcacacctgacacatatactttctgctccccggctccttcagctgtactcactctttgttaagtctcccacaattaccattgttcctggcccggactccaatccggcctcccacattattcctgataccacacatgacccccatgactgtatctctctgatccacctgacattcaccccatttccccatatttccttctttcctgttcctcacccaatcatgcttgatttattgactggcggttccaccaggcctaatcgccacacaccagcaaagacaggctatgctatagtacaagccactagcccacctcttagtacctctcatttcctttccatcgtggaaatctatcctcaaggaaataacttctcagtgttccatctgctattctactactcctcagggattattcaggccccctcccttccctacacatcaagctcaaggatttgcccccacccaggactggcaaattggctttactcaacattccccgagtcagataactaaaatacctcttagtctaggtagacactttcactggataggtacaggcctttcctacagggtctgagaaggccaccgcagtcatttcttcccttctgtcagacataattcctcagtttagctttcccacctctatgcagtctgataacagacgagcctttattagtcaaatcagccaagcagtttttcaggctcttagtagtcagtgacagactaatggtctattaaaaacacacctcaccaagctcagccactaacttaaaaaggactggacaatacttttaccactttcgcttctcagaattcaggcctgtcctcggaatgctacaaggtacagcccatttaagctcctgtatagacgctcctttttattaggccccagtctcattccagataccagaccaactcagactgtgccccaaaacacttgtcatccctactatcttctgtctagtcatactcctattcactgctctcaactactcatacatgccctgctcttgtttacactgccagtttacactgtttctccaaaccatcacagctgatatctcctggtactatccccaattagatgtcctaggtcctcccaattcttagtcctttaatacctgtttttgtccttctctaattccgtttattttttaattcatacaaaactgtatccaggccatcactaataattctaaatgacaaatgtttcttctaacaaccccacaatatcaccccttaccacaaaatcttccttcagcttaatctctcctactctaggttcccacgccgcccctaatcctgctcgaagcagccctgagaaacatcgcccattctctctccataccacccccaaaacttttcgccgtcccaacactttaccactatttcattttatttttcttattaatataagaagacaggaatgtcaggcctctgagcccaagctaagccatcataccccctgtgaccttcacatacacatccagatggccggttcctgccttaactgatgacattccaccacgaaagaagtgaaaatggcctgttcctgccttaattgatgacattgtcttgtgaaattccttttcctggctcatcctgtctcaaaaagctcccctactgagcaccttgtgacccccactctgccctccagagaacaactcccctttgactgtaattttcctttatctacccaaatcctataaaatggccccaccctgatctcccttcgctgactctcttttcagactcagcccgcctgcacccaggtgaaataaacagccacgttgctcacacaaagcctgtttggtggtctcttcacatggacgcgcatgaaaagaagaatactttaaaaaaaaaaaaaaaagcagcatcagcaccacctggaagcttgttatttatacagaatctcagacccacctgaaacctactgcattggaatttgcattttaacaactctggtgatttgttttctcatttcacaagttgtagtctgtgaaaaatcaggagctatcaggaaaggagatctactcccctggctactgcgaatcaaggtttcttctgcatctacgactgctacccataaaatgtgaaatacccttcaggaatctatacggctctaaagactcatagtgagatgttaagtatccctttctccttcctaatagcagcctatttcctttcaaggaattctcttcccctgttctatgtcttgttgtgagggttaatttcaggtgcctgctaacccaaacaagccagagaagcaattcttttctctaggttctcaaccaggggtgattttgccccccaggggacattttggcaacatctggaaacatatttgtttgtgacaaatgacagggagagattctggcatctagtgaaaagcagccggagctgctgctaaacatcatatagtacccaggatggcccctcacagcaaataattatccagcccaaaatattaataggaccaaggctgcgaaaccctgaatgagtaattacatatattctccctctttcaggaagtctcaatcttgagagaagggggaaagagaaatagaacatcgctgtcacagcagcgtcactgtgacccaactcttcctgcctagatgacctgcttcctccctcttgaccctccagagtgctgtcaattccctaccatggagccctagctttgcataaatcatacgagccccaatttccttccagttcactgtcatttgcccaagtcagccagtatctttctgttgatggtaaccaagaacccttacgcccaaccatccaattagaggagggctccattccagggcagggcaggcttacccagctgctaggctaagcacacacttcaagcatcagcaagtaactgacaagttcagcttgaatgaacttaaccagaatttgcagtcaagaaaactagaaagaaactgttttaatttcagtataagtgtttcattttgcatcaagtgatttaaacagttcattatttgggaccctgatgttctgggccatcaggtggggcaggtttgctctggttttgagtttcagtgctaagaaggaagaggaaaacgagagagaagagattgagttgtttatattatctggcctcaggtgagagagtactggaatgagaagcctatgtttaaaggaaaaaaatattaaaactgggaaagtattgaacatggaaagatgtaacctatacaatgaagtacagcacaatggaagaacctaaaaattaaaaccaagaatacatatatatatttcttgatatatatatcaagaaatagcaatctatctgcaagccgaaaagtgttgcagaaggaatggaggctttgtcatcgaatacacctgctggtttaaccaaactaagattgaaagtaaaaaccttagcctgggaaacatagcgagaccccatctctacaaaaactgaaaaaaatagccaggtgtggtggtgcatgcctgtggtcccagctacttcggaggctgaggtagaaggattgcttgagcccaggaagtcgaggcagcagtgggccgtgtttgagccactgcactccagcctgggtgacagagtaagaccctgtctcagaaaaaaaaaaagaaagaatgtaaaagcgtttgaagccatttggcaaagatcatggaaaacagggcaagcaatagctacagagttccagagccatgttaaattaataaataagtaaatatttaaacattgaataccttaacaattaaaaatcatatctatctattatattgttgaatgacaaaagcctattacaggatgattctacctatatcgacatttgcatatatgcataaagcaagtctggaaggaccttcacaagcatgttaacaatggtcacctatgggtagggagatcttctttgaatttttttttttttttttttggtgcattagcgatcttgatggtttcaaatgtcatcaccagggaatgataaacgctggggcctacttagggtggagggcaataggagagtgaagattgaaaaactacctatctgatattatgctgattacctgggtgacaaaattttctgtacaccaaatccccaagacacacaattagtgcgtgtaacaaacctgcatatgaatccctttaaagtaaaatacaagttgaaaggaaaaaaataaaacctcttcaatcatctttcagatagcaatttttttcattgcttcttcagtgtacataaatattcttttacatcattcacacttctttgaacttttctgtactgtttaaatatcgcaataatgtttatgcatcctattttaaaaacaacaacaacaaattaaaaaataaaaaggagaaggaggaaggtgaggaggagaaaaagaataacaaaaaagacttgtgatcctaagcatatagacagctcagaaattgcaggaaagctgaaaaagaaaaacaagagaaaggtaaaggaagaatgatcattaataatattactaaattgggccaggcacagtggctcacgcctgtaatcccagcactttgggaggccgaggctggtggatcatttaaggtcaggcgttcgagaccagcctggccaacatggtgaaaccctgtctctactaaaaatacaaaaattagctgggcgtggtggctaatggtgggtgtaatcccagctacttgtgaggccaaggctggagaattgcttgaacccagggagcagaggttgcaatgagccaagagcacaccattgcactccagcctgggcgacaagtctctgtctcaaaaaaaaaaaaaaaaattactgaattgggctacagattcttagagctgctgatgggactttcatgaacttctaattcagagatccccaaaccagaccacacattagaattccctgagggctttttttaaatattgctctgaataaacacataaacaagcagttcccttggcccaacccatctttgacctactgaatcaaaatatctggaatgggattggggaatctgcacattgaccagcccgtgcaaggatctaaaaccagcccctggcaaccactaatgtacttctgtctctacgaatttgcctattctagatgttccatataaatggaattatatggccttttgtgactggcttctgtcacttagcatgttttcaaggtccattcatgttatagaatgtattggtacttcattcctttttatggctgaattaatatttcattgtattgatataccacattttgtctctccattcaccagttgatagatatttgagttgcttccacctgttggctattgtccacctgtttctatttctatgaacatttgttcacaagtttttgcttgaacatctaggggttttgtttgtttggttttggtttgggttttttgttttttgttttttgttttttcagagatagggtctgtcacctaggcaggagtgcagtggcaccttcttagctcactgcagccttgtattcctgggctcaactaatcctcccacctcagcctcttgagtagctagaactacagttatgatgccaccacaccctggttatttttttaatttttctgtagagacaagggtctcactatgttgcccaggctggtgttaaactcatgttctcaagcgatccttccaccccagcttcccaaagtactggggttacaggtgtgagccatcacacttggccattggatacctgtttttagttcttttgggtatatacctaagagtgaaattgctgggtcatatggtaattccacatttaacttattgagaaaccatcaaactttttagggtttttttttttttgagacggggtcttgctctgttgcccaggccagagtgcagtggcacaatcatagccccctgcagcctcaatctcctgagctccagtgatcctcccacctcagcctcccaagtagctgggactataagcacatgtcactacacctgactgactttttttttttttttttaagtagagacaagattttgctatgttgctcaggctggtcttgaactcctgagctcaagcagtcctcccacctcagtctcccaaagtgctgagattacaggcatgagccactgtgcccagaccactgtttagttttttaatgtggctactaaaaaacttgaaattacatacatggcttgcattatgtttctgtgaaagagtgctgctctggatgcttctttctgcccaagtattctactggaacttacctctcatttacctttgccctcacctgcttccaaacaagactcaaggaggaacttaatactataaaacagccaggtgcagtggctcacgcctgtaaccccagcactttgagaggccaaggcaggtggatcatttgaggccaggagttcgagaccagcctggccaacttggtgaaaccctgtctctacaaaaaatacaaaaattagctgggcatggtggtgcgcatctgtagtcccagctacttagggagctgaagcaggaggatcacttgaacctgggaggtcgaggctgcagtgagcatgattgcaccactgcactccagcttgggagacagagtgagaccctgtcacaaaaaacaacaacagaaaataaaatactacaaaacaagttacatgaaaatgaaagtctttaaaccaagagtgaaaaaaggtaggggatccaggcgcagtggctcacacctgtaatcccaacactttgggaggccaaggcatgcagatcatgagatcaagagatcaagaccatcctggccaacatggtgaaaccccatttctactaaaactacaaaagttagctgggtgtggtggtgggcgcctgtagtctcacctactcaggaggctgaggcaggagaatcgcttgaacctggaaggtggaggttgcagtgagccaagattgcaccactgcactccagcctggtgacagagccagactctgtctcaaaaaaaaaaaaaaaaaaggtgggggaggacaagtaataaaagagggtggcaagaaggatcgattttgtcagagaaactgaataacaacagctaacatttattgagtgtgtgctttgtgccaggctctgctaagtgctttctttataatctttttttttttagacggagtctccctctgtggcctaggctggagtgcagtggcacgatctcagctcactgcagcctccaaatcctgggttcaagcaagtctcctgcttcagcctcccgagtagctgggactacaggcgtccaccaccatgcccagctaatttttgtatttttagtagagacgaggtttcaccatgttggccagggtggtctcaaactcctggcctcaggtggtcgacccacctcggcctcccaaagtgctgggattacaggtgtgagccactgcacctggccagtgctttctttataatggactcttcacaccaattctatgaggtaggcagtgtggtaatgttattatacacacaaagctgataagcagcacaagattatagattcagacccaggccttactccgaaacctgagctcttggcaccctggtagccaatgcgaagatggaaacatcagctctagaaagcccctaccacagagtctggaaagacagacgatgcccagtaagttatttccctgcccattctcacactaactcagagggagaaactttttcttgatcttgagctccacagggaatttgaccctgtggctttgtacaagaaacactaatacgacatagtgggtaatgtcccccatatcaatgttaccagaaatgaagcagcatgccacatcatatgaaaacagagggcataatgttaggtcttaatttattaagtgcagttcagtcgggatccaggagcttagacagctgatagcaagctttcactttatcttttagaatgcccttttgcccttttgagtctcttgcctggaaatggtctatgacagacctctgctgccctctggtgggcagagcatgaagcacccagcaaagaattctttccagtcacatggcctcttctttgtttatattgctgaatctgtgggaagctgggcttctccacacaatcccttgaggagaaggcttaacttgtatatgaaaggaaagacacctctcccaactcaagagcaacccactgccaggatacgctctgggcctcctgccttcctcaccccacttacacgccttaccaataacatcatgcccccacgggagcagtggaggctgcaggggcccatggtattgctggggccaagggcacatatggagtctgagatttctacaaccagatggtcaagaagcagggtggagaagggaggagctgcgtggttctggtcaaagaacaagtctttctcagcctacactggagccccagacattcctgcccacgatgaggaagctgaggagcagggcgggggagaagggtggcttttcaacctggtcagaggctaatttcggggtgcaaggtgagagagtaggatcacggtccactgagacctgctcctgggtcatttccaccccaggaccaaggctgaaatggacttaaaccctgaggaaggaaaggttctaatggcttctttagttcagggtccaacagtagagaaagctgcccagaaagacctgggggtgggaatttggccccagctcagcctttaaccgccagctttcaaatttaacccttcagcactctctctcatctctatctctctctcatctccatctctatctctctatacatctatctatctctctatctctctcgacgttgctacctgtaagcaggtcagcagctccctctggaaagggtgagcctccagacgaggaggaaaggtctgcaaggagcagctctcccattgctcagcctgagctgtgcctggggctcacacctgtctctccagtcccactctccaccctgacagaacatcattctgcaatatgagaggattcccagactgttgtttttcattgaaagttctaccatactgatgatttttttttttttttttttttttgagatggagtttcgctcttgtcgcccgggctggagtgcaatggcaggatctcggctcacttggaacttccacctcccaggttcaagcaattctcctgcctcagcctcctgagtagctgggattacaggcgtgcaccaccaagcctggctaatttttgtatttttagtagagacggggtttcaccatgttggtcaggctggtcttgaactcctgacctcaagtgatctgcctgccttggcctccgaaaatgttgggattacaggcgtgagccactgcacccgaccactgctgagtgtctgtgccttctcccccttgttttcatcctggcatgtgaaattctggtttctacctggttcagaacatttatctcttttcagtacagtagacatgtcaatgttgcctgatctgaaaaagagtggctggcatgaacctcgcagtggccaacccagaaacatccatgactccaggatcatgttgcagggaactgggaagggccagtgtctgtgtgatgggctgctgaacattttggcagatccctcttccactgttttatcattttgttgtttatttaaaaactcgaatacatgcacatagtttttttaaaaatcattatatcatcacaccaccacacccggctaatttttgtatttttagtagagacagggtttctactaaaacagtcaaaggcacagctactcagaaggctgaggtaagagaattgcttgagcccaggaggcggaggttgcagtgagcggagatcgtgccactgcactccagcctaggcgacagagcaagatttcgtctcaaaaaaaaaaaaagataactagttaaataaattacccatttcatagagttctattaaaagaatatacgtgatgacatgaaagatctccaagatacacaatataatccatttcatataaataaaaaacataactttaaaaaattatcttggtcccaagaacctagggatatcccctccctaaaataaagctacctggaggggacaaactgcctgtcttggagccaagggctggccctcaaggaaggaggtccaaggtgggaacattccaacatctataagaaactagccactcggctgggcacagtggctgacgcctgtaatcccagcactttgggaggccaaggcaggcagatcacctgaggtcaggagttcaagataagcctggccatcatggtgaaaccccgtctctactaaaaatacaaaaattagtcaggcatggtagcgcgcctgtagtcccagctactcgggagactgaggcaggagaatcacttgaacctgagaggcagaggttgcagtgagccaagattgcgccactgcactccagcctgggcaacagagtgagactacatctcaaaaaaaaaaaaaaactagccactcacccttgttccaccctcaacccacattctccaataaaagaaagaaggtcagcaggtctaaaagagactgacctccacccccaccagggcttgagaaagacatctatggcaagtcactctcagtttagtttccaccctcaacccacattctccaataaaagaaagaaggtcagcaggtctaaaagagactgacctccacccccaccagggcttgagaaagacatctatggcaagtcactctcagtttagtttccacccatctcttccctagccacacccaaccaaaacccattttcagtgtcctcacaaagaatggattacccatctgtcctaaatatgtaaatcgtacaatcccacaggcacacacataccctctagctctcccatatcatctgagccctcaaatagcacaaacaagaggtcagcaccagcctttatcgggaaagagaagcaccacacacccactacccaatccagggctatttcccatgctctggtcagcggcaggaggagaagcagagcagagagggccatgagtgcccctggaaatgtcacaagccccaggatgtcaccctctcttgactgccaggaaaagcttccagaattaccaaagaagctccagacaaatcagcacagctagggcaccgggatctctgcaagtagaagaaacatcaagtcacagctgtgccctcctggcttcagctacctgaaatgttttccctccaccctaggaaagcttggcctatattgctctcaaaagtcttaaatagctccttgcttcccagacaatccaatccaaactggcactgaaggctcttattattcagatgtcaaccttgtatctcctgttataaaaaactggaattatggtcgggcacagtggctcatgcctgtaatcccagcactttgggaggccaaggtgggtggataacctgagatcaggagctcgagaccagacctggccaacatggtgaaacactgtctctactaaaaatacaaaaatcagctaggtatgatggcaggcgcctgtaaatcccagccttgggaggctgaggcaggagaattgcttgaatccaggaggcagaggttgcagtgagtcgagattgtgccattgcactccagcctgggtgacaagagtgaaactccatctcaaaaaaaaaaaaaaaaaaactggagatacgtctgttcctttacccaccctgcccccactcctcacctcccaaacatatcccacacattcccaccctgtgttcctttgccagcaatcaccagattgcctatctggcatgtccctgtgctatcctccctttgtcgcatctgcctagccttaagcacctcaatcaaatcccacctctcccacagagaccttcccagggagccacacctgggaacaggtgtaagcctgtactgtttatatgagggttctcatctgggacacaggtttgccacacctgagaacaggtgtaagcctgtactgtttgtatgagggttttcatctgggacataggttctttctctccaactagacttttcctgaccttctgaagtccccttcccagcacctaagccagtgctttgcacatagcagttgtctgttattgttgatgacaatggactgtactcacctaattcggaatcagacctcacagtccagttggggttcatggtcagttttgggggcaggactggtgggacacagaagcggccacagcctgacttgcaacatttttctccagcttgacaattctcatccatcacacagccaacaatgcacaggcccaccagaacttttggacaatcaccgccccgccctgtgggaacaacaggcacaggaaaagggacagggcatcagctctgccatctccatgttcccatcgtgaacttacacacagaggctctaggtcaatcaacccctgaccctcactagacccaactaaactggctgggaaaccatggcgctggaggatctcagaatctttaggaacccaagagacctctgagcccagagttttcaaatggtgccccaaagggagttcccaagaggtaactcagggattgacacctctgcaggtttggggtgggggtgggtgaagtgtggcaggggcaagcctcccagaccactccccctccccctatgctctggattcatagtgtcacttcttcacggtggcctcctctgccaccctagacaaggtttgatgtccctgctttgtgctcctgtagcaccctgtatgcttcctctcatcaaactttatcataatcccttatttaaaaggaatatgtctatcttgcctgatgggctataagctacatacggacaagagtctgtcctcagccttgagcactgcctgggaatctaaagggactaagatagcacaagggtcaatgattctttaatggagatccacagtgcctggcactcaaaaatatttgtttttttaaaatgttgaagaaaaaaaggcattggaacaggaatgcttttatctctgtgtgtgtgtgtgtgtgtgtgtgtgtgtgtgtgtgtgtgtgtttccagctgggcgtggtggctcacgcctgtaattccagcactttgggaggccgagacaggcagatcacgaggtcaggagttcaagaccagcctggtcaacatgatgaaaacccatctctactaaaaatacaaaaattagctgggcatggtggcgtgtgcctgtaatcccagctactcaggaggctgaggcagaagaaaccccagaggcagaggtttcagtgagccaagatcacgccactacactctagcctggggtacagaccaagactctgtctcaaaaaaaaaaaaaaagaaaaaaaagaaaaaaaaaaaaaatatatatatatatatatatatatatgtgtgtgtgtgtttccaactaagatttcatttggggcaggggagaagctttttgttaaaaattagatctgaaaatcaggatcttgggcaactccttcattttacagataaagaaatttgggctcaaaaagacgggtttgcttacctaaggtcacaaagcaaaacctcagcagaatcaagaccaaaagccacactgtctgtcttccagcccaagtagttcctactgccccacagtgccttcccccagttcttttaatgtcgacagggcccctcggccctagaagaatgggttgctttgggttgggggaccagagggacaggaaggatgagaatcctagctcctcccaggaagggaaagagaagcactcttctcaggaaacactcaaggatttcttcccaaaagagccaacatacctccctcaatgtctccgaggcaggtgcggccacagccggtgctgcagcatttatgcccctggggacaggatgcatccccatcacacagctcctcacacggaagggggtcagcgggacattcaccaccaaactctgctacataatcaaagcattggagcccagagacgctcacaatatgaaacacatttttcattgtgtcccatgtgtatgtttatatatagttatatatttatatacatatataatgtaaatatttatgtgtatcatgtatctgcaatacatctgattttttttaagacagggtctcactgtgttgcccaggccaaagtgcagtggcataatcatagctcactgcagcctcaaactcctgcattcaagggatcctcccacctcagcctcctgagtggctagaactacaggcacatgccatcatgcctggcttatttatttatttattttgtagagacagggtctcactgtatcacccaggctaaagtacagtggcacaatcatagctcattgcagcctgaaactcctgtgctcaagggatcctcccaccacagcctcctgagtacctgggactagaggcacaagccaccaggcctgggtaattttatttatttattttgtagagacagagtctcactatgttccctaggctgatatcaaactcctggctcaagtgatcctcccgcctgagcctcccaaagtgccaggattacaggcgtgagcccccccacccagcccaccctgatattttatattctagttcttatttttcctaattactaaattgctttcaggactcacagtttgaaaaacactgttcaggtctaacccactgtggccaacattctccctgaattctccctgtggcagacatttacaatggtggcctccagtgaactttacctcctgggattcaggcccttttgtagtccccttccatacctactctgggtttgaccatctgacttgctttgaccaatgggacattagcaaatgtaatgtaagcagagccttgataagcactagcatactggggcttgtccactcagaatacttcctcttggaaaccagccgccatgctataaagcagcttgaactacgctatgggatgatgagatgccccatggagacagaacctagaagagaggtcatcctggacgttgtggctccagttgagctccctgctaagctcccagatgaatgcagctaaatgaatgaccacagctacatcatgtgggtatatgaactgcccagccaagctcaggcaacctacacaactgtgagaaagagtaactatattgctttaagtcatgaagtttggagatggtttcttatgcagcaatagatactggataccaagtttattctgagaggcaacaggtccagctaaaatgatttgtttccccatactctcttgcaacaaggggtgaccacaaactaggacataaactgggaaacttttgtattcctgacacagggaatacccctttcaaactgctccctcacttctttcttcttccagtccaaagatagacattacacagagaggcagagtagccttctttcaatgaggaggcaactcagcataacgaaatggtcaagaattgcaaagaggtgttgtatgaaaggagagaaggttagcactcccctcgacaaggatggaagaggcctttgggcctgacaacatgcatatggttcaagcattgccacctactttgtggcatctaaccatcgtcttttaaaataaataaataataaaatgtaaatgtaaaaaaaaaaaaagaattgcaaaggagaaagagggaaatagtttcatccttgttagcatcatggagccaccatcccagcctcaggaattcttgttatatgagaaaaacaaacccctatatgattaattttctgttgtgtgcagccaaacacatttcctatgaaaataaactcagagaagaatcttgcccagaactacagagtgagtcagcagcaaggcaggacaacactcagcctcttgatttgcggtaaagtactttttctactacactatccttaaaacatgcaggcaactggccagggccccaggcgcaggcacacccaaagaaggccacatccaaaccaaaccaattcaccatgactcattcatcttagtgtttatttcaagcttcttaagtaaagagaaaggtgacaggcaattaaagatttcgcagaaaaccaaagcaagactggcccagtgcctctgagtaggaacaggtaagtatgattgcatacagctggctctgggaagtctgccatgatggaaaaagcaagtattggaatccaaggagaatacatgcagctaaacaacccaggcgtagtaaccctgtatcctgagattttcctgaacagcccctatttcaaatatcctgtgctactgtgagatcacatcaaaactatgtgtcctgatttttgactcagaaaatgtggtcactgtaaccaccaaatgcatctccctgcacctccccacctgcttgacaaacactgaaatccatttaacaaggaacaaaagccttctatctcacagctgagaaggctgggagtaaaaatctccctggtggaaaaacccggtgacataaacatctcataaaattatgccatgtgccctagaaactgggagtgccatacgtcccagatttcaccattttgctgagcttgaccttgagatgaccaatgccaggagctctctgctactctctgccctcgtcctcaagaccaggcatggagcacttacctctacccttttccaggccaggcttcctggaggcccagagggtcacagcacctcgcttttgaccagtgcccagcaatgccacccagtctgacaccctgccttatatgaatccctgccacgtgatccctttctctcagctctaacacctggaattaatggggcctcactacctccaagccagattatgctatcctacttaagctagacagcctttatacctttttttttttttttttttttttgagacagggtctcgctttgtcacccaggctggggtgcagtgccgcaatggtggcttactgcagcctcaaactcttgaactcctgggctcaagcaatcctccaacctcagcctcctgagtagctgaactataggcacacactaccaggcccagctaattatttttattttttatagagacagggtctcactatgttgactaggcttgttttgaccttctggcctcaagcaatcctcccgcctcagcctcccaaagtgctgacgtcacaggcatgagttaccatgcctggccctttgtacctctttatactgacctgaaatctggctgggccttttcctatccccagagaccttacaaaaacctggcggatgccattctttcaggcaggatcctctgtctttcacgatcctggctttgccatgctaggtaaggtcagttcctcataagacatgctccctaatcacctcacaattagcttaccaggaatcaggaagagaaataggaacagtagccagaatggggatgacggttccccaccctctatcagcacccatcccaagactctaagctatcaccaaaaaaggagtgaagctgaagcccaggaaatactcactcacagtctgtcctgctgcctcagctccaacctgccactatgtctgagagaaagatgccagttgttgttggaaaagtaaaatttcagcacttcttaacccaagaagggccctctgagctaacaaacttactccccttctcttgtaaatagagagacagacaactagagagagggattggcctgaggtcaatggtagcagaactgagtcacaaatccccagctctgatataaggtctcatgccctttaaaccacatcatgggcctggctcagtggctcatgcctgtaatcccagcactttgggaggccaaggtgggtgaaacacttgaggtcaggagttcaaaaccaatctggccaacatgttgaaaccctgtctctactaaaaatacaaaaaaaaaaaaaaaaagccgggtgtggtgatgggtgcctgtaatcccagctactggggaggctgaggcaggagaattgcttgaacctgggaggcagaggttgcagtgagccgagatcacaccactgcactccatcctgggtgacagagcgagactccatctcaaacacacacatagacacacacacacacacatcatcatgatcccctacactgcagcaaggatcacacaaaaaccaagaagcactgggactcactctgcccagttccaccaaaagagaagatccagtggtagatagttttagaggttaggaaaagttatccaccagtgtgtaggcagtcctcaagaccacttacttccaggttcagtgattcattagcaggactcagcgtatagtcatacccatggctatgatttattacagcaaaaggatacaaagaaaaatcatcaaagggaaaagtccagaggaaatcaggtgctgattttcaagagtcctcccggtagagtcacaggatgcacttaattcttccagcatggaattatgacatgtgtgaagtgttttctaccagggaaactcattagacactcactgtgaaagttctctactgggggctggtcacttaggcaccctctgcctagcacgtaccaagattccagactctcagaaggaaagcagatgttcagcctaaaccacaatgtttacacaaacagtttaggcacagtgaaccactcttatcagttagagtagtacaaatacccacaaaatccaagttcccagaagccagccaaggcccagccttgccagcaagcctttttaagaagagcggtctcaggcttgttatgttaactcttttctgtacaacctgcagtgaggttttagaaaagggtcagccagacacccagggaggccatgccatcagcccacgtaaaagataatacatatatgttaataagcaaaacagagggtcacaggggatctggagtggtcaggtttcatacagtggggaggtgagccatgaggaggcccaagaagacaactgtcaggccagaatcagaatcttcactccaaaacctcttcccccaggttgtccctgtctcagtaaagaacaccaccatcacccaactgctcaagctgaatatctaccacccttcttgataccccgtctccctcaatgcctgcagccacttacttgttcacccagtcccattaattctaccttcacaaacatgtaagccttccatttttctttttcattgttattggttttttgggggcttttttgttttggattttttttttcttttttttgagatggagtttcgctcttgttgcccaggctggagtgcagtggtgcgatctcggctctctgcaacctccacctcctaggttcaagcgattctcctgcctcagcctcccgagtagctgggattacagacgcccaccatcatgcccggctaatttttgtatttttagtagagatggggtttcaccatgttggccaggctggtctcaaactcctgacctcgtgatctgcccgcattggcctcccaaagtgctgggattacaggcatcagccactgcgttcggccgccttccatttttctatgtctgcagtatctccaacccagtctaagccccgatcatctctcccagcctgccacaatagcctcctaactggtcttccatcttctacacttgcccccatccattcttcatatactggcagagtggtctttttaaaatgaaaactggacaaggcctctcctgcttttaaaccccctcaaaggcttcctattgcacttagaataaagcctaagagagaagccctgaagacccccgaaagtctgggccctgcctacctctccaacctcaaatgaaagcagcctccttctctcttcttcctttaccttcaaagcactcatgactcatcatcatcttggggttattatgtatttgttttcttgattatttcctgtctgtcacactatatgagcaagccccagggtggcaaggaccacggctgccttcctcaccactgcagacccacatgccaggtagggtagccacactcaatatacagtgaatacatgaataagtgggtgagtaaacggataggtcaggcatcagataggtggggaggcagagaaggggcggaccagaacacagaggtacttggcatgaccatatgagctctcttgagcattatctggcaggtttactgcagacttttttaaatgcatttctggccggacacagtggtttgtgcctgtagtcccagtttctcagggaactaaggcagaaggatcacctgagcccaggaggttgaggctgcagtgggctgagatcacaccactgcactccagcctgggtgatagagtgagaccttgtcccagataaataaataaataaaatgcatttcttctcaactgcattatcactctgggagctaaacatccttatccccattttacagataataaaagtgagattcagagaaatgaagggacttgcccaaggccacacagcaagcaagcagaagagccaggattcagacccatgttcagactagaacagtgtcatgagagcaggacccaatgtctgcccttgccctcaggcaacctgactgaacctccactttgccaaacagaccagcgctggctatggtaaacctctggcaatgtcagagcttaaggaaagcgaaatttttcatagccctggaaggagagcttcctgtagagttgggtatagcaaccagtcctgttgggtgagtagcctagccctcccctagggctggagctatacaaaagtagttaactaccaatgcagtagccagtatcacctcccaccaggctaggaaccccgctcagcccagcaggctctgggacatctgcgggagatcactattctagcctgcctgccaagctccagtggaaaaggaagccctatctgggctggccaggggccagagcagctcacaaaggtactgtgcctgggtgccagcctcgcccttagcccctacaattcagccctcagcttcaaacactgggaagattgtaccaagccctacatgccagcagtcagtgacctgcctgagacagattcccaggctggttccagagctgggcctcaagagtcctggcaaggagaacaaccttccattctctctaatgggcaggctgcccaagatagctgcctaagccgggcacagacagacccaatgggtaccagcaaggggcctcctacctggagaggtttgactggaaggaaaaaggttgtcacatgttacagggcttcaggttctgagaggaagtgatcagggaagaagaaaaccatcctggttttgaataaaggggctggtgagaaattgtactcctgctgggcatggtggctcacacctgtaatcccagcactttgggaggccaaggccggtggatcacctgaagtcaggagtttgagaccagcctgaccaacatgctgaaaag[136 bp omitted]cactccagcctgggcaacaatagcgaaactcagtctcaaaaaaaagaaattgtacttctgacccaggccacttaggaggcaagaggaaggaagttaatatatactgagggcaaaacactttacataatttgaataattacaacaagccttcgaggtttattcttcccaccttacagagaagggaactaaggctcaaaattacttgcccagggacctgctggccagtaactggcaaacctcaggcttgaacccaggactccgacaacccaaacctaggattttccactctaacatccaccacatgcactcagataagagaatgattccagttcctttagaaaacataatgagaaatattcaaaacagcagagaagaaaataaaatacctaggcataaatttatggagaaatattttaacactataaaacaccctgaaatatgcaaaatacacttgatcaacagggaaggcataggattcaacataggccaggcacagtggctcatgcctgtaatcccagcattttgggagccaaggtgggcagatcacctgaggtcaggagttcgagatcagcctgaccaacatggcaaaaccccatctcttctaaaaatacaaaaattagctgagcatggtggcacacgcctgcaatcccagctactcaggaggctgacgcacaagaatgacttgaatgtgggagcagaggttgcagtgagccaagatcacgccactgtactcctgcctgggcgacagcctgtctcaaaaaaaaaaaaaaaaaagaacatttcagtaccataaaacagggtaagaaaaaaaaaagattcaacattataataacagcagttctccttaagctaatttaatttatatatctaacatcactccagtgaacgtagtcttggtatttgggaatgatggaagaaaaatagataatattataataaaatatatttggaagcacaaataagcaaaagtagccatgaaaatcgtgaaacaagaggaaaataggaaggggttagacatagaagacatgccatcaatttctaatatgttttaggggcctctcaagggaatggagaaggaatagagcagagagccctgtcacttctacctccaaattttctcaactatgtcacctttctccatccccgctgctacctccctagtctcacgggtctacatcctcatctgccttcattctctccctcccatttctactctaaccgtactagctttctttccatttctcaaatgtggcaagctcctagtcatcttaaggcctctgtgtgtgcttctctctctccctggaatgtccatcgcacccttcacctggctaacttcaaatcgctctccaggttgcagcttaaatgtcactccacacatgccatcctcaaccacccaaaccaatgtgagttctcagccgggcacggtggctcacgccagcccttgggaggccaaggcaggtggatcacttgaggccaggagtgtgagaccaacccagccaacatggtgagaccccatctctcctaaaaatacaaaaattagccaggtggggtggcatgtgcctgtaatcccagctactcgggaggctgaggcaggagaattgcttgagcccagaaggtaggtggaggttgtagtgaaacaagatcgtgccactgcactccagcctgagcaacagagcaagactgtcaaaaaaataaaaacaaaaataaaagtgagttctccgctttactctgtctctcagcaccctttaattttccttccctgtccttatcagagtttgaaattatatatttatttacatgcttatttgttaaacctctttctctgccatgagactatgagctccatgaaagcgggcatgggatctaccgtattttccacaatataccaggagcccgtcactggatctcgcaaacagtacacattcaataaatacttgttgaagaaatgaatgcataaatggataattaggtcactgggactctgcaaaagggagaatgaatctctttcaaatacctctctaccaggaccagaatgaaaaagaatctgtttcccacaggagacagccccgccgtgtgtgtacatagggaacataagaatctcaggagcaggccaggcatggtggctcacgcctgtaatcccagtactttgggaggctgaggtgggtggatcacgaggtcaggagattgagaccatcctggctaacatgacgaaaacccgtctctactaaaaatacaaaaaattagccgggtgtggtggcacatgcctgtagtcccagataatagggaggctgaggcaggagaattgcttgaacctgggaggcagaggttgcagtgagccaagatcacaccactgcactctagcctgggagacagagcaagactctctctcaaaaaaaaaaaaaaaaaaaaaaaaagaatctcgggagcaaatgagtggggaaatgtgtgccaccttccataggcatcaagattcttttttttttttctgtctctgcagattctcaggataagattttttaacagagaatattgcaactgattatgggaactgggaattacccagtggttttcttttttcttttttttttttttttttttttttttgagacagagtctcgctctgtcacccaggctggagtgcagtggcataatctcggcccactgcaagctccgccttctgggttcacgccattctcctgcttcagcctcctaagtagctgggactacaggcacccgccaccacgcccggctactttttttgtatttttagtagagacggagtttcgccgtgttagccaggatggtctcgatctcctgacctcgtgatccgcccgccttggcctcccaaagtgctgggattccaggcatgagccaccacacctggctactcaaccgttttcaaagcagtctgcaaatgagggtaagttgaggctgcccttctggcaccctccctctgcctgcccaggctacataccacaaatgattatggcttgtgcaccctttgtatatcttttttttttaaggtcttagaatatagcagcaaagtaaaaccaacaagctgatatgtgcatatttgagaaataaacaagcagaccaaacagaccatgaggtgtggggacagcgtttcttacccagcttctgtttagagattgggactacacagctcttgttgcagccaagcgtgcagcatttctttacacctggacatgtctcatcagtgatgcaccttttcaaacaggattgtttccgaataaccctagggcaatctcttttcctccctgtagcaaaaagggagacagcaaagaaaagagaaaataggccgagcgccatggctcacacctgtaatcccagcactttgggaggccaaggcgggtggatcacctgaggtagggagttcgagaacagcctggccaacatggagaaacccc[135 bp omitted]cattctagtctgagcaacaagagcgaaactccgtctcaaaaaaaaaagagagagagagagagaaaatagtgcctggcaacacccacgggcacagcagaagggaaaaacagaaaaaggaagtcctgagatttatttaagcctctcaaccctggtgctaagacaaagagacaataataacaacaatagtaatagcaaatatttactgtaacatttactgacgtttaccttgtgccatgaacatcttatttgatcctcacaattatccccattttatagatgaggaaactgaggctaaaagcttaagatttataaagagctaaggcttaaggcttaaaaaggtctgcttggctctagggtctactctcttaatcattatcttacacagccttccctttacaactcttccctccagccttcacaggaactttgagtccaaagtaaaagacatagataatcaatggtgcgctctttcctgatggaaggcaaacaactgggggcactgaataattaaaggaggagggaccctaaaagagtaaagaagaagtactctaggcaagggagacttccagaggcaacctagaaggtgggaagctctctacttccatctatcccagaggcaatgtcagagagtatgcccagattttgcccctcatgccaacatacccttaggaatgtctcggcagatccgaccacagcctgtggtgcagcacttctgttcagccggacacaattcatcaccctggcacagctctttgcatgggttcttatggggagggcattctccctcttttgctgcaaaagatactatttgagtttggggtaactagccaggcctcagaaatggggaatggaccttcagcccctccaggcatctctatccaaaatatttctgcaccactgcactctagcctgggtgacagaatgagaccctgtctcttaaaaaaaaaaaaaaattctggctgggcacgatagctcatgcctgtaatcccagcactttgggaggccgaggcgggcggatcatgaggtcaggagatcgagatcatcctggctaacacagtgaaaccccatctctactaaaaatacaaaaaattagctgggcgtggcggcgggcacctgtagtcccagctactcgggaggctgaggcaggagaatggcgtgaacctgggaggtggagtttgcagtgagctgagatcacgccactgcactccagcctgggtgacagagtgagactccatctcaaaaaaaaaaaaaaaattctgcaaccaccttcccctcctcatacacaaatactaacatatatccaccactgctaaaggagcagccatcctgcagataacgagagagaaagggtgggatgatcctgttctcatttaatgagttctagggaaaagctagaacctctagtaagcccaactggaagtcctatctccttgtccagagagggtaaagaaagccaggaagaatgacccaggccatcctgagaatctattcatccagtcctgtcctatagagatgatcatctccacttacaagcaaccttgctctgggagaaggcaggggatgagttctcctctcctctagtcactttctgttactgttggccagggatcccaaatgatagctcaccatgttctcctgcagttatccaggattccagagacccaagagcaagaagtgccttcagaagaaagaggcagcttaacatcatgatgatgctgagagttgggacaagagctcagttcaggctagaggtgtacaccttgcccagagtatcagctgaggtatgagcaggactagggatggccccaaacccagtcccaaaaccttccctttcacaatactccccaagaatatcttctcctgacaagaagaagagggattggctgctggagtgtgggaaaattcctggcactaccaaaggggacctgtgatgggaggatcaaattctgtaagcaatatacacaatattcctggatgatgagaaacctagtgggtggctggaaaaatggaggggtggccattggaaaaagaatcaaagagagccctaaagggcattggaaggacatggctttagcccaaataacagagggagggattcacgacactacttaatggccaaagctaataacataaccaagcataataaaattgtggctcctgttcatcctagcaaccaagaaaatacagaatggaacagaccactcagaaactatcaaataggccaaggcgggcagatcacctgaggtcaggagtttgagaccagcctggccaacatggcgaaaccctgtctctactaaaaatacaaaaatcagctgggcatgctggtgcatgcctgtaatcccagctacgtgggaggctgaggcaggagaatagcttgaacccaggaggcagaggttgcagtgagtggagatcatgccactgcactccagcttgggtaacagagtgagactctgtctcaaaaaaaaaaaaaagagagaaaagaaactatcaaaaacctacagaaaagcagtagttgagtttgttaagaactaatgaaaagcaccaaacacctacatctttgtccctctaacccacacaggccattcttggactgtatgaagtctagctggcagaacccaagagaagttgctatgtatgactcaaatagtctgcccacatatacctcctttatttcttttttctccatttctttttttctttatctgtcctggtcatgcctttggttagctgtgatacctaatggtgtccactggcactgcttagtcctatgggcaggtacaaggtaaaacctccttaataggatcaaaaagtttggagccaggaagtcgcccttatggttagaaggctgatgttggctcatggagataattaacatttgatgatgacctcatatgtgcctaatatgcttttttttttttttttttttttttttttgagacagagtctccctctgtcccccaggctggaatgcagtggcgcgatctcggcataattaacatttgatgatgacctaacatgtgcctaatgtgctttttttttttttttttttgagacagtctccctctgtcgcccaggctggagtgcagtggcgtgatctcggctcactgcaacctccgcctcctgggttcaagagactctcctgcctcagcctcccgagtagctgggattacaggtgcccaccaccacgcccggctaatttttatatttttagtagagacggggtttcgccatgttggccaggctggtctcgaactcctgatggcaagtgatcctcccgcctcggcctcccaaagtgctgggattacaggcgtgagccaccgcccctggccgagcatattaaaatctagttttcaaaaactgaactgcaggcgccgctgtaccaaacgcttccctctgctccccaaccccagcctacagaaaactggtcccttcctcctaccccgcagtcatccccaggccttggcccagcgggaaacatcccttgactgaaccgccactgaacacccacactgcacaatcgaggcgcagccctcccgagaggaagccccaacgacctccacctacaaggcctctaagtgtaactgtcctgggcgaggcgcggcggttcggttcccatggtaaccccgcagctccagcgtcgcgcttccgggcggacgagcagcgcgctccagtgacgtcacggcgccactttccggccggtgacagagtccagcggagttgtgggggccgggggcgccatgggagccactggcgacgccgagcagccgcggggacctagcggggccgagaggggcggcttggagctgggggatgcgggcgcagcggggcagctggttcttacggtgagggcgcccccggtgaggtctgggctcaggccgggcacggcctcggggctcctgggaccctggcccgcgggcgagagaacgcggaggctggagctgcagagggggttggcgttttcgcagcccgacgacctggatttaaattctggtgccgccctcctagctaggtgacgtgggccatctctgtcaaccccctgagtcccaggatcctcttctataaaatggaaatgattagtacctgtctcataaaacttgttgtgggatgggaagataaaggcgggtacaacgccccggacatcacctgacacagagttgaccctcggtaaatactgcttcccttcctcctgccgtgccagaaggcagggtcgggacttttaaggcaggaaacttcctcagttcctcttttgtggaggaggccttacaactatcgtcccaccccaaggcgggagagatggtgacggatctgagaagcagggatgtccaggtttaacttcatacccaccctccacctccaccccaccccagtgtcacaggccgcagtgacatttgttccgttggtccccacagaacccttggaacataatgataaagcaccggcaggtgcagcggaggggccgccgctcacagatgacaacaaggtaaggctggccctgcatggggcttatatcccagccactggcttgcatggcagatttgggatccccagtgcacaaggctatggagatctacagccggtagaaagagcacaggactgaggaagaggagactccgattctgtaactctgtgtgatcttgaactagtcaagtcacttccttctctgaactcacgtacaaaatggggaagggcacaggagatgggttgtggaataaacaatacctaagatccctcacattcactggctctgtggttgagggctctaaagaggtcagttagcatggagtttaagagaacaggctctggagtcagacaactgtgttctcatcaacagactctgatgagcccgttttctcaactataaagagggattaatagtatgcatgtcagggaagggagagagcacaaggtgggcctttgggatgctgatagtggtgaaatggatgttcactataattactcattaaagtgtatagacttttctgtataagtattatatttcataaaaacactttgggccgggcgcggtggctcacgcctgtaatcccagcactttgggaggctgaggtgggtggatcacctgaggtcgggacttccagaacagcctgaccaacatggagaaaccccgtctctactaaaaataacaaaaaattggccgggcgcggtggctcacgcctgtaatcccagcactttgggagtctgaggcgggcagatcacctgaggttgggagttcgagaccagcctgaccaaaatggagaaacccggtctctactaaaaatacaaaaattagccgggcgtggtggtgcacacctgtaatcccagctactaaggaggctgaggcaggagaattgcttgaacccaggaggcagaggttgcagtgagccaaaaccacgccactgcactccagcctgggcaacagagtgagactccgtctcaaaaaaaaaaactttgaaaataatatgcacttcatagagttattatgagaaagaaataaagtcatgcctctgtgatttgcacaaaatctgagcatgtagctagttttcaataaaagctgtctagtattgttaaggaattctatgtccataattaactggggaggctgggaaagaatatgtttgggacatgccccctcaccctgtctccctcctgaatgcagtttcacagatcctgccatctccatggatctcctccgagctgtcctgcagcccagcatcaacgaggagatccagactgtcttcaacaagtacatgaaggtgagagggacacaggataaaaaataacaggagaaagactcatgaggagcccagtccttgcctgcatcaccagtctgtctctttcctacatacagatatctaaagttttcctttcttgttgtttttgttttgttttgttttgtgtttttgagacagattctcactctgtcacccaggctggagtgcagtggcacaatatcgattcaccgcaacctccacttcccaggttccagcgattctcatgcctcagcctccctagtggctgggattacaggtgcccaccaccttgcagggctaatttttgtatttttagtagagacggggtttcactgttggccaggctggtctcgaactcctgacctcaaatgatttgcctgccttggcctcccaaagtgctgggattataggtgtgagccagggcacctggtcagttttcaaatttttaatcccccaagaattttattccctccttgagggtaattcagataccttttttttttaaaatctgcccttgtcacgcacgtggttttttttgctgacctcttataaggatgaagtgacttaaatgtactgtgctgagcactgtgctccagacataacaagtgtccaataagtattcttattagttgtttaataatataaccattattggggccatgcacagtggctcacacctgcaaccccagcactttgggaggccgaggcaggatcacttgaggccaggagtttgagaacagcctgggcaacacagtgggacctcatctctactaaaaaaaaaaaaaaatttttttttttttttttgagacagagtctcactctgtcgccaggctggagtgcagtggcacggtcttggctcactgcaacctccgcctcctgggttcaagcagttctctgccccagcctcccaagtagctgggattacaggcatccgccaccacgcccagctaattttttgtatttttagtagagacggggtttcaccgtgttagccaggatggtctcgatctcctgacctcgtgatccgcccacctcggcctcgcaaagtgctgggattacaggtgtgagccaccgcgcccgtcctgattttttgcactatttacacctcaatctgttgggcacccccacgattatatccgtaagagggggaataaagggaggaggtcaagcctgaaatgtgaatctaaatctggctgatcccaaagccctgctcataatcacttttcccttctgtatgaagctaggataaagacttattttatattcagtttccttcaggttgatgcacattaacaggactctgaccttgtcctctgttgtgctcccctagttcttccagaaggcagcactgaacgtgcgagacaatgttggggaggaggtggacgcagagcagctgatccaggaagcctgtcggagctgcctggagcaggtgagaccaaaggggacaagagatgcaggcacaaggtttagctctcgagcctctgataagaaatgcgatcttaagccggacgtggtggctcacacatgtaatcccagcactgtgggaggccaaggtgggcagatcactcaaggccaggagtttgagaccagcttgggcaacgtggctaaaccccatctctacaaacaatacgaaaattagctgggcatggtggtgcacgcctataatcctagctgcttgggagccataggcacgagaatcgcttgaacctgggagacagaggttgcggtgagccgagatggcaccactacactccagcctgggtgaaagagcaagattctgtctcaaaaacaaacaaaaaaagaaatgtgatcttgtcatcagtggtattttggggaatgcccagcaagccacatattgagataggcttgaggctgttgctgacagggaaaggaagggaagtagctactatatgtcaggtaccaggataaatgcattatttttttttatgtctcagaagaaactatgtacagaagatatcttttaattactattttatagatgaagaaattgtgacttagcaaactcatagaagcagagagtagaatggcagtagctggaggggagaagtggggggatgttaatcaaagggtacaaacttttagttataagatgaacaagttctgggcaatctgatgtacagcatgatgactatagtttatctctattgtttacttgaaatttgctaagaccatagatcttaagtgtccacacacaaaatggtagtggtggatgtgttgattgatttcattgtggtaatcatttcactatgtatatctatgtcaattcatcacattgtacaccttgaatatataccatttctgtttatcaattatacatcaatagagctagaaaaaaatttttaaaagcaaagcaaaaaaaaaaaaagaaatggcttaagacacataataattagaatagctaagatctgtctcacccctgcaggtgcgtggtggatcaagttatcatggccccatttggtatcatggggatgagcaccctgctgcctccctgcctctctggtgtggtcaggaagcatgacatcaggtctataaatgactgttcccaagatagtagagaacctgtttacatgtgtcagctgctgttattaggaggaattgttgccatcaccattttatagggagacatcaggaaaggtcgccaatagtcgctggctcactttctcacctcctattcattctcttcactttgttttcgcttcagtccccactacttcactggaacccctcttgtcggggtcgctagtaacttccgtgttgtcaaaccctctggtccctaactgtcctcaacttactcagcttctcagtgacatctgtcacaatggatcatttcgcgtttcttggaatgctcctctgttggctagagtgccttgactttgctccaacctcattgcctactcttctctctcaccccccgcctctaactgttggtgccttcccaagttcagtcctcaaaccccttctctttcatggctcactgttttcataggtgttttcatctagtcctgtggcttggaagccaattcagccgctcataattcacacatttatatctcagtccagagttacattcaccgttacccagttccaatccactcttctcacagcagccagactgatctccgtaaagatgaattagatcatgtcactccccattttaaaaacccttcagtgactttcctgttgcagggagaataaagtcttaatgccttaccatgatcctgctgggaaaactggctagccatatgtagaaagccgaaactggatcccttccttacaccttatacaaaaattaattcaagatggattaaagacttaaatgttagacctaaaaccataaaaaccctagaagaaaacctaggcaataccattcaggacataggcatgggcaaggacttcatgactaaaacaccaaaaggaatggcaacaaaagccaaaattgacaaatgggatctaattaaactaaagagcttctgcacagcaaaagaaatgaccatcagagtgaacaggcaacctacagaatgggagaaaatttttgcaatctactcatctgacaaagggctaatacccagaatctacaatgaactctaacaaatttacaagaaaaaaacaagcaaccccatcaacaagtggccaaaggacatgaacagacactcctcaaaagaagacatttatgcagccaaaagacacatgaaaaaatgctcatcatcactggccatcagagaaatgcaaatcaaaaccacaatgagataccatcttacaccagttagaatggtgatcattaaaaagtcaggaaacaacaggtgctggagaggatgtggagaaataggaacacttttacactgttggtgggaccgtaaactagttcaaccattgtggaagtcagtgtggcgattcctcagggatctagaactagaaataccatttgacccagccatcccattactgggtatatacccaaaggaatataaatcatgctgctataaagacacatgcacacatatgtttattgtggcactattcacaatagcaaagacttggaaccaacccaaatgtccaacaatgatagactggattaagaaaatgtggcacatatataccatggaatactatgcagccataaaaagtgatgagttcatgtcctttttagggacatggatgaagctggaaaccatcattctcagcaaactatcacaaggacaaaaaaccaaacaccgcatgttctcactcatgggtgggaattgaacaatgagaacacatggacacaggaaagggaacatcagacaccggggcctgtcgtggggttgggggaggggggagggatagcattaggagatatacctaatgttaaatgacgagttactgggtgcagcacaccaacaaggcacatgtatacatatgtaacaaacctgcatgttgtgcacatgtaccctaaaacttaaagtataatttaaaaaaaaatgccttaccatgacccacagagcctaccctcgactggcttctgcctgcttctttaacttcatttcatctcacctcttttttattgactatactctggctgttctgaactcctttctgctcctccagcacaagcttaggccatttcacttgctgttcttagtacctggggtactctacccttaactctataaagccggctccttcttttcttcagatcttagtttaaatatcagagaggtcttcccctcgcactcctacctctgctaaaatcttgagctttacaagagttgaggcctaatcttgttcaccactgtattcccagccctggaatatgactcttagtatgtgtacagagtttgctgaattattgagtaaatgaaggaacaaacaaatgataaatgaacaaacaagcttcctgctctaatagaacttaacagcctacttaagcagacaggtgtgaattagattaccaacaaatgtgtgcataattacacattgagacttgatcacccttcactggaaagggacaaagtttggaggagaagagcatgaatccaattatggattagcagctttgagccatccaagcatagacatggggcagactatttggtatataagtctagagctcagaggataaccttttgtctacagttgaattatggaatcgtggtttatagatgttaattgaagctgtgagaataggtgagagcagatagaatatgtaatgagagaggatagggaaaagaaccagattgagaaggaaaagccagcaaagaaggctaagaaagaacggccagagaagtagaaggaacacaggaagtgtggccacaggagcctgtagaaaagagtgtttccagaagggggagccctcagcactgtcaaatgccactggcagaggtcgggtgaacccaattctccacctgctgcaccatctcccctctgcccattccatccttttctttgtcaaatgagccaggtgttcccacctttgagcttctgcactcctccctgctgctgaaacacttctgcccagctttttttacagcctccttcacatctcaactcagaggccaccttctgagcaaggccttccctggccattcccgcaaagtagcccttcccctctggtggttctctgtcacatctgcctgggtttttttctttttttctcacagcatctatcatgatccacagttaccttgtttgtttctgtgcttattatccagatcacccacaaactataagctccacaagagcttgtcctagttactgctgtgtccacagcacttaggtcccaggtactcagtatttattaaaagaaaaacagcaggccaggcgcactggctcacgcctgtaatcccaacactttgggaggctgaggcgggcagatcacgaggtcagaagtgtgagactagcctagccaacgtgataaaaccccatctctactaaaaataccaaaaaaaaaaaaaaaaaaaattagctgggtgtggttgcacgcctgtaatcccagctactcaggaggcagaggcaggagaattgcttgaacctgggaggcggagattgcagacagccgagatcgcaccactgtactccagtctgggcaacagagcaagattccatgtcaaaaaaaaaaagaaaaaagaaaaacagcagcttactgaggagtatgtgttatactaatgtatttagtttgaaaaaacatacagtatgtatttacatgggaaaagcaaggaagaatttacattgaaacattaatagtagtttatgtaatgagattccaggtttttcttattttgcttttttacattttttaatttttccagccatgatcattaattcaagtttttttaaaaatagatatctatttctatgcatataaatatatatatgtgtgtggctgggcgtggtggctcatgcctgtaatcgcagcactttgggaggccaaggcaggtggatcacctgaggttaagagttcgagaccagcctggccaacatggtgaaaccccgtttctaataaaaatacaaaaattagctgggcatggtggtgggcacctgtaatctcagctgcctgggaggctgaggcaggagaatcgcttgaacccaggaggcggaggttgcagtgagctgagatagcaccactgcactccagcctgggcgacaagagtgaaactccatctcaatttaaaaaaaaaaaaaaaatatatatatatatatatatatatatatatatatatatatatatatatatatatatatatatttggaagtgggccgatcacttgaggtcaggagttcaagaccagcctgtccaacatggtgaaatcccgtctcttccaaaaatacaaaaattagctgggtatggtggcgcacccctgtagtcccagctactttggaggctgaggcatgagaatcacttgaacccaggagatggaggttgcagagagccaagatggtgctgctgcactccagcctgagcaacagagcaagactctgtctccaaaaaaaaaaaaggaagtaggtagggtgtgcttacccaccaaaatagtgactggtaacacttggtctttttcccttcaggctaaactgctcttttcagatggagaaaaagtaatacccagattgacccatgagcttccaggaataaaggtcagagtcactgtgttctcgggtattggagcgggaggtccttcaggctgggaggcaagtgaaatatgtgggcccagggaggttccatgtacttccatttgtaggaccaggcccacacagcatcatgctggatgggcttctttggcctgggtcagagcggggctggagagctgtagtccagggctgtcttctgcaactccagaagacctgcagctcccaggcactggccttccactgactcccttcccttttcttttagcgtggccgtcaggcagaagaagaatgtgcccatcgaggaagcccccttcctaaaaaggtaaaccatttccttgttttgttttctggctgaaaaaaggcttgtcaggccgggtgtggtggctcacacctgtaatcccaacactttgggaggccaagcggggaggatcacttgagctcaggagttttgagaccagtctgggtaacatagtgagaccctgtctctaaaataaaaaaaaaattagccaggcatgctggcacatttctgtcgtcctagctacatgagaggctgcagtgggaggatcacctgagcccaggagttcaaggctgtagtgagctatgatcatgccactgcactccaggctgagtaacagagtaagaccctgtctctcaaaaaaggctcttcactccgcaaggtactgggcttcctcaaagcccttttgagccttcctagacatgagaggcagtttttctccctgtccctgtcaaacatcatttgatctctttggaaaaccatctctgccaagtgaccctggacctgccaatggggtatggggagtaaccacagggtcagacctctgacagctgttttttgtggcagaggaaaggacggcctcctggacacatcctgtcaagcgaccgggcagccgccggcatggtgtgagtagggaccaacagtgtggtgagagcataggggagcagacggagagaggggccctgaaggaaaagagtccagggttctgtgcctgtcaaaatcagatccatcagcttaagtcatcgtggaggggggttatcctggttggaggggtgaggaaggagggtagtgaggaggaaattgttttaccccctgaacggtttggcccagcttgatgaaagattaaactccagaggtttgtcattgttagtatatattggatgcttatgactggtctaaatacgttacatactttaccttttaatctttatagccaccctgtaaagaagatatcattaatttttcagataacagactcagagaattacttgcctaatgtcatatcgttaacattgcctccaagacggtcattttcaaatatatatttttttaagacttaatttttttagagcagttttaggttcacagcaaaattgagaggaaggtacagacatatcccgtatactccctgaccctacacatgcacagcctcccccattatcgacatcaggcaccagagtggtacatttgttacatttgatgagcctactttgactcgtcttgatcctcagagtgcatagtttccatgagggttcactcttggtattgtacatgaacttagacaaatgcatagtgacaggcatccaccattctagtatcacactgagtgctttcagtgccctaaaaatcctctgtgttctgcctgttcatccttccttccccctcaaccaacccccaaccccactttttaaaaaaaattctgaagcagcagaatctttttcaaacaaaactttacatgggagcccagtatttaaatcaaataaagccacactggtctggttcaggggcgtggggttagtttggaacagctggcttagtagatgggctagtattaactgtcataccttagatgtgtctcctacacgaagcagttttattcctcacaaacacaagataggtagggcagttgctgtttttgtctcttttgacagatgagaaaactgccactcagaggttcttggagttgctcatgccactatgtaagagcagagctagtgctagaatggcttctagtccagtgctttttttccctttgttcctcctcttatgtgtcaccacgaaggaggatgtccagggctaaagtgagagtgtgtgaggaactcctaccaccaccagcaagctggcatttagtcctaggtctcaccttggagaattcacctttattctttccttccaagcagatggaaaccaaaatcctgtgaaccaattcgccgggaaggccccaaggtatgattatgtgagcatggcagagatcacgatcccaggagatagtcccactatctctaggacccaccatgagggaaaggggcagggggcgaagggtgcatgcacaccattccagagccatctgcccctctccacctccagccacactggcctcagagaggatcctgtgtaggaattggagttagaggcaaaacaaagagagggcttgagtctttgctgaagccttctccttataggagttagtggtcactaatactgattcaatacttagtatgtaacgggcagtgtcctaaatcttttgtgtagaccatctcatttaatctttataacaaacttatgagatcaattctgtgaaccattctataaatgaggcgtttccttttctgccagcttccctgtgggcataaattattttattcagttgtcttatacacttaatgcacttaagacttgcccaaagtcacataactcgtaagtgatcgagctgagtctcaaacccaagacccgctgacaccagagtctgtgctctcaaccattagcctctgttgcctccctctctctcctgagttcttcctcagcagtgacttatataaatggttgttccccagaattctctccttggcccacttctccatctaaagtaactctctggataatctaaaacatatactcttatggtttcagggaccaccatgttctaaaactcccatacctctttgtccatcccatgcctctttctactttaaaacttgtttatcctactatctgcttgaccactctgctggaagtttcataggcatttcagactcagcatatccaaacatgaaattagaatctttcctcacagcccttctttacattcgttatcttaatcatctttgcctcctcctcctcttccttacctccctacacccagtcgagtcctggacaattcttcctcttaaatatattgcagttcctatttccttctgttcatccttactgctgccctagctcaggcccttagcagctttccaactgctttatcacagcggcctctaaactgctctccctgcctgtagtcttgccccttcaaatccattatccacattgctagaagactaagctatctttaaaggaaatctgactctcactccctgtttagaggccttcagcgattccccattgcctacagaagaaataaaatgcagtcccctgaacataacctcctaagacctccaactcctctgtgtttctctctccagccccatcagctgccactccctaatttgtactctctctgttagcagcacagaattactagtagtttctccagcaggccaagctgcctctcacctgtctttgctcatgctgccccctgtctggaatgcccttgttcctgaccccctttaccccaacttgtgctcaccctttcagaattaacttgggaaatgcctctctaaggaagccttcctggctggaccctcccctcggcagccctcagaccctgcactcacttgtgtccttgcctcatcgcacaatggtgtaattatctgtacatatgttggtggcatcctagaaaacagagactgtatcttattcatctctttatccccagtatctagcacagacagggcctagcatattgtgagtactcagtgtcttgggtcaactgttgattaaataatagacaaggggaagggttagaaaagggtagggggaggagtgtttctgtcctacccatcagattaaacttcaccctcacgagcttctctattttttgcacagtgggacccagctcgcctgaatgaatctaccacctttgtgttgggatctcgagccaacaagtaagtttaagagctttggcactgattgaggaaacagctcaggagttcactagtaggactacactttctggaatcttgaccacttggcttttacttttcagagccctggggatggggggcaccagaggaagaatctacatcaagcacccacacctctttaaggtaggtgactgctgggaggaaagcaggccattgcattgggagtagactgggaactccactcagcacagagaagcttagaacaaacactgatcttggagtcaggacatctgggttctagttgtgcctctgccattcacctttccctttcatgatttactcaacacctctgtgcctcagtaataacagctactttgcttgcatgcttactgggtgccaaacacagttttaaatcccacacttatattatcttaaaaaataagtattgccatccttatttcacaaatttgaaacaatcagaggttgagaaaggctgagtgacttgcccacagttattcagctagaaatggtgagtcaggattcaaatccaggtctgtcctcaccaaagcctgagctcttaaccactaccatatttggttgtctgtaaattagagtttgggccaggtgcgtgagctcacacctgtaatcccagcactttgggaggccaaggcgggtggatcacctgaagttgggagttcgagaccagcctgaccaacatggagaaaccctgtctctactaaaaatacaaaattagctggcatggtggctcatgcctataattccagctactcaggaggctgaggcaggagaatcgcttgaacccaggaggcggaggttgtggtgagccgagatcacactgccctcatatttgcattttaaaataactctggggtctggcacagtggctcacgcctgtaatcccagcactttgggaggctgaggctggcggatcacctgaagtcgggagttcgagaccagcctgaccaacatggagaaaccccgtctctactaaaaatacaaaaattagctgggcatgatggcgcatgcctgttatcccagctattcaggaggctgaggcaggagaatcgcttaaacccaggaggcagaggttgcagtgagccaagatctcaccattgcactccagcctgggcaacagagcaaaactccatctcaaaaaaaaaaaaatagagtttggagcaaggcagggtcctgtgccttttcaaagagggtactcctcttctgagagcagctatgttttggtccccactgtttgagggaataatggaggaaatcataaactcactcaccctcttagatgattttgtattttatcagtcacgagagcatcgaagtagattagaagaatagcagtgcatgtgtgttccacacatggttttttgcacttatacgtaaggcttggcacctcttgccagaactgcacagccctgtgggatcccagaatcacgggctttctctaccacattctgtgcaagttttcaagttctttgaaaggcatacctgctcacgcttcttctccagtctgatatcctcgagtcccaacacttaaacagtttgcccagtggctcctttgttttcctctcttaatgtcgtcactcttgctattcccattgcctgggtggcctttctctcccacccttatctgcctgactattctttaagatccacctcctccaagagctttgtttgtatcatccccaaaatcaatatgcttttggacctactttgaattcccacttcagcgtggtttaaagtatggcttcaggcctggttccattattttactagctgcatgaacttgaacaaatggctccacatttgtttttcttttttctttttttttaactagctcaagtctgggaattgatccacatttctgagtctgtttttgtcctgtataaaatgagaatagtgatagaccaaccatttttttttttctgagacggagtcttgctctgtcacccaggctggagtgcagtggcgcgatctcagctcaccgcatcctccacctcctgggttcaagcaattgtctgcctcagcctcccgagtagctgggattacaggtgcccaccaccatgcccggctaatttttgtatttttagtagagatggggtttcaccatcttggccaggctgctctcaaactcctgagctcagatgatccacagcctcagcctcccaaagtgctggaattatagacttgagccactgcacctggcccaactttacaaattctctattagtgattataagtatcttttcagtcatttagaatctatttgtatttcttctgtaagctgcctgttatatcttttgcccatttttctctccttcagaaggcattattcaaattcttttccttttttaaatgttttgattatagaaataatatataaacccattcccgtggtaaaaagattcagacgatacacaggaggtagtagagagcaaaacacagtttctcagccaggtgcagtgactcacgcctgtaatcccagcactttgggagcccgaggcaggcgggtcacctgaggtcaggagttcaaggccagcctggccaacatggtgaaaccccatctctactaaaagtacaaaaattagccgggcatggtggtgcactcctgtagtcctagctactctactcgggaggctgaggcaggagaattgcctaaacccaggaggcagaggtttcagtgagccgagatcacgccactgcactccaacctgggcgacagagcaatactctgtctcaaaaaatatatatatcagtttctcttcactcctcgattttttttttaaggtgcttaaattctggtttctaggtgcccaacctagaatagaaaccagaatttaagccttatttgggttgagcacagtagctcatacctgtaatcccaacactttgggagactgagtgggtggatcagttgaggccaggagttcaaaaccagcctggccaacatggcaaaaccccatctctactaaaaatacaaaaatcagctgggtgtgttggcacgtgcctgtaatcccagctattcaaggctgaagcagaagaatagcttgaacccaggaggtggaggttgcggtgagccaagatcatgccactgcactctagtctgaacaacagagcgagacgtcatctcaataaataaataaacagccaggcacggtggctcacacctgtaatcccagcactttgggagcccgaggtgggcagatcacctgaggtcgggagttcaagaccagcctgaccaacatggagaaatcccatc[131 bp omitted]cactccagcctgggcaacaagagtgaaactccgtctcaatcgatcaatcaatcaatcaatcaataaaccaaccaaccttatttgtaactccaaaaccgaattcttaaccatgatgctattatgcgtccgagagtacatgaggtgtcccgatttttgttttattatggtcaccataataattacagacgttataagccacctccgatcattttttaaaaagaggaagctctaaaataatagttatcagtcccaccagttgcccggggtgctttgttgtgagaagggggtggggattgggagtatactaagtctctgggaattgggtcccatggtctgccctcggggttggcttagctttctctgaagagattagtgagccctctaagtccaccacgcttggagacaaggacttttggtaagaactgctcaagggccaagagtatgctctgggaccaaatgagaaaagccccttacccgaggctaattttcttacaacttcattccttacagtatgcagctgacccccaggataagcactggctggctgagcagcatcacatgcgggcaacagggggcaagatggtaagcattattcatttgtgccactgccagtgacccaccccacctgggaaccaggattttggctgtgggtgacagcctacctccaaatctgacttccaaagcctcaccaatgtgtgagaagagagacttataaggcctatttcttcatgctgaagagcaaattgtaatcttcaggttcccttccctatccctaggtctcccttccgccccctcacacttttacctcatgcctccaagatcacatatttggatactattagctgtccataggaatagcaggtataagacacacagtactactttttcccactactgcacccactgacagatttcactcattgatcactcttccaccagacacagctatagaatcttttctcaacacagtacttgaggcagcaacccttgtcagtaggagttagcaatgaaatgtgtttgcacacttggcagccccttccagatttacctctacttgaagagttctcagatcatatgaaacagcaaccttaggaaaatcatcattgcatgtgttcaaaaactattgttgagggctttgtccatcacacacaatgtcccccacctgaggactcactcactcccaccacaggtactgctccttttagaatctaagtgccttacaaactgatatgccatctcctttctggcagtgagagctaccttttattttattttactactctatttatgcctatgctttacttcaaaaaagatttcaggtaagcttcatgcacataaaatgcaacattacataaataagaaatagatggtagggggtgggggcaggacctaaaattaagccaccagtaaaagtagttctttaaaaaaaaaaagtgttttttatattgctgacctgggagacctgtgcacttctacagatgttggcaaattcagctgtaggccccactcatggacacctgatctgttatggttcatagtgcccataagatgtagacaaattactcaaggaatacacaattattcctgaccctaacattagaaagtctcccacagaagactttctaatatgatgaatatctcttcctatatgttaagttcacaaaagggccctcacccactgtagaccgaggcattgtgacaaagcatttctacaggccccagtacaatacaggccaattactagacagcagagcagtttatcatgttttccattttgccacaaagttcaaaaccaagttatctttgtcctcagagggagcacatggtttcctcttcctgatttcctgtttccatatatattttgctggctttcttgccattttgttataacccaccttgggtcctttcgtatacttgatcttaaccaaaaggtgtaggagcaatggtggatccctttttttttctttttttcttttttttttttttttcttaattttcaccacaccattcaagagagaaatgggtccttttttaaaagagaaggctataaataagtcaccagtccctactctcccatccatgaagcatctactgtagtaaaagattgtctcaaggaaccattcccatccctccccacttactcttccgtactaaattgtaaaccgcatcccccgcttccacctagtagcaggccttacattaaacagatgtttaatgaagtgttactgagttggagtgaaatgaatcaggcaatgaccactctcccttgctcctgcctcaggcctacctcctcatcgaggaggacatccgggaccttgcggccagtgatgattacaggtaaaaccagtgggtctcctgccccttctcctctccctgcctccaaatagcccctagaatgaggcagggcctacatcctcacttcccccaacttctctcttcaatgtctgttccagaggatgcctggatctgaagctagaggaattgaaatcctttgtcctaccctcctggatggtggagaagatgagaaagtatatggagacactacggacagagaatgagcatcgtgctgttgaagcacctccacagacctgaggccgggtcccctggccacacttggcagccctcctccaaagccctcttcctcacgtggctgaggccaccgctgggactgctcctagatggatctcagcggcattaagctgtgcctgagcgagtttgtagtgactcactgcacagcacccccagactagcatgtggttctatatttgtaaagttattgggataagaaacaattaaacagtttgtagtaaacacagatggtgaacctgctgtgccctctaccttgtgggaattgacagaacatcaagggctctagaagtgggtgtaggaaaaaaggacgagataaccctcacccataacagtatagagccaggcttgataagaccaacctgggagcaccatgtaccctgcccgtcttccctttgcccatttgtagtttccttacccagctaatgtaaggacatggcagaatgcgatggagtttgatgacagatcatatgaaaaatagagttggcttttattgctcccattttacaggttaagatactaaaggacccgccccaaggttacacactacccactggggaggtaggatatacaggatatgaacctgtgttgttggggtttttgtttgtttgaagacagtcttgctctgttgcccaggctagagtgcagcctctggctcaagcgattctcccgcctcagcctcgccagtagctgggactacaggctcgtgccacctcaccagccttttttttttttcttttctttttttttttttttcttttaagtagagacaggtctccctatcctgttgctcaggctggtctcgaactcctgggttcaagtgatcctcctgcctgggccttccaaagtgttcgggattacggacgtgagccactgcgaccagcctgaaccaatgttgcctttttttatttctgtcatctctgcggagatgtatggacctatgttttctaatagggagcctgctgctctggccatcagcctttagtttttcccctcgctgggattttcagatacttaggacgcagcaaaggtgcccaggcgattataatggtgggagggtaccagtgctgcaggattggaggcactccctgcccgagggaaattggatcaaggctgggcgtgccgagtgttcccacgcggagtaagacgtgtagccagaaggaggggttcatcccacgtggacgttttcttggccctttaatggttagcgttttccaacggccaccaattcgctacggattcgttagttaatggcagcatcatctaccaatcggttgtcagaagcgggattctgccgcccaatagcggtgcgccagtgggtaggtctagcagtggcgcagcaatagagcgctccggagcgtctcattggctggatcaaacccaagcgagccattgattggtcgacgcccccagagggttacaattcaaacgcgggcgggcgggcccgcagtcctgcagttgcagtcgtgttctccgagttcctgtctctctgccaacgccgcccggatggcttcccaaaaccgcgacccagccgccactagcgtcgccgccgcccgtaaaggagctgagccgagcgggggcgccgcccggggtccggtgggcaaaaggtgagtgatgcggcctaccactcgccgggcctgccatgccctaggcattggtacccagagcaaagatttctaggaccaccccccgccgccacctcctggagcgggagatctgcgggtgcaggagaacacaccaggagctcggggcctggcattcccctgggcatgggtgtcgagggcggagacttccgggactcccacctccttgcgcgggtgagattcgagagatgggggacaggccaggagctcagaccgctctttgagactctcccgaaggagaatgggagggtaggggcgctgccagactccttccctggtgggcctagatgaagacgctcaaggaccctcgtgacttggccgagacaggggaagggagaagttgagtcgggcaaggaagagatgctaaagcctggggaattaagaacatgccagaatcatcccgagggagtctggaattagggagggtgaggactcgctaggatcgtcctgtggatctggtgagtataccctgagctgagcctgaccttggtgatgtggggagcctccatgacggctccccctgagattcaggtgggagaagatgcaccgtctggaggcctggcccatccagactcccaggtaaccccgaatactcttttttcaggctacagcaggagctgatgaccctcatggtgagtgattaagtgcccagaaccccagccttccatccaattttcagtagcctccttttttccgtcagcttttttgctagacataggggtaatgtaatttgctccctcctgggaaagaagttcatacaccccacctacaccatttcttccagcagtccctcctcccaattccatccccccacacgaagttatctcgaacacttccctgaagtcatacaagaccctccctatccagtgtgtccctacttcctagccccaaccaagctttacccacacccaactccccgcccttcttggtatttctagcctatgaatttggttgctttattttggatcagagtgatgagattaaggggaggctgggcgcggtagctcacaccttataatcccaacactttggggggctaaggtgggcggatcacttgaggtcaggagttcgagaccagcctggccaacattgcaaaaccctgtctctactaaaaatacaaaaattatccaggcatggtggtgcatgcctgtaatttcagctactcgggaggctgaggcacaagaatcatttgaaccgtggagacagaggttgcggtgagccgagcgcaccactgcactctagcctgggcgacagagtgtgtgtgtgtgtctgtctctgtctatctctctctctcaatctctctctctctctctctatatatatatatatgtaaatatatattttttagtagagatggcataaccccatctatatctcatatatatacacatatatatgtgtgtgtgtatacatatatatgtgtgtgtgtgtatgtgagcatatatatatatatatatatatatatataaaattaaggggaaagctcacccactgacctttgctatgcccaaaagtgtactccacattccaacaaatgtgttttctccccagatgtctggcgataaagggatttctgccttccctgaatcagacaaccttttcaaatgggtagggaccatccatggagcagctggaacagtaagtgtagggctgggatgggtgagtgagtctggggaaaggtgggaagtgagatccaagtgcgagctctgcttcaagcctttggcggagcaagacactcctcctgtgactgtttacattctctgagccatgtggccttgttctttccctctgtgcaataaagggtgggtttaaagcagggctgcctatcttagatgtttacatggggggacagacagcaaggaaatggatgaagtgaggactttggccaatagggccagatctcaagaaggcagcttcccattgctgcagatcaggtttaagatgagtcagaagtccaaatctgtgccaaatctaatttttacgtattagcaactaatattcttttttttttttttttgagacggagtctcgctctgtcgcccaggccagactgcggactgcagtggcgcaatctcggctcactgcaagctccgcttcccgggttcacgccattctcctgcctcagcctccgagtagctgggactacaggcgcccgccaccacgcccggctaattttttgtatttttagtagagacggggtttcaccttgttagccaggatggtctcgatctcctgacctcaagatccacccgcctcggcctcccaaagtgctgggattacaggcgtgagccaccacgcccggccagcaactaatattctaattgaactaaagcacaggatgccaatttacaatccttagaccaaagagtcactgatgtctccaccagataagaggaaagcatcaggctaggcatagtggctcacacctgtaatctcagcactttgggaggctgaggcaggcagatcacatgagcccaggagtttgagactggcctgggcaacatggtgaaaccctgtctctaaaataaaaactaaactaaaaaaactttttaaaaaggcagtggggagcatcagaaccagctcaacagtttgtctactgtccggtcccagagaaactcaagattctagcaagccccttgtgtggggcttgggttgggacatgaggctgctgctggagcttactctgcaactgtttctccaaatgccaggtatatgaagacctgaggtataagctctcgctagagttccccagtggctacccttacaatgcgcccacagtgaagttcctcacgccctgctatcaccccaacgtggacacccagggtaacatatgcctggacatcctgaaggaaaagtggtctgccctgtatgatgtcaggaccattctgctctccatccagagccttctaggaggtgactttagagaccacccctcccctccatgcaacttgggaacctgtcaggactccctggggtcagcctcttctaccgccttgaccttctctttctctccacccacagaacccaacattgatagtcccttgaacacacatgctgccgagctctggaaaaaccccacaggtgagtcctcagtccttgagcccagggtgatccctcccccaaccttcaaaggctccctcaaacaaaaggagcccagtgacttgggaccgggttggttggggcagggtggagtgtcggcagcaacccacttctgtttctgccccagtgctcctatttgctataaaatagcaattgttttatagcagaataaaaatgtttggcgataaataattttgggaaattattggtgagaccaaggcaggaggatagcttgaggccaggaattcagtagagtgccttgcctgtgccctccagtctcactggaagcaagcccttccaggagagctgcctagatgggcagtgcagggagaatgccgggctgggaaaccagcccctcctccacctcctccgacctttgcatccctggtccagctgcctcttgcccaccttaattcatcctgggccaggcacagtggctcatgcctgtaatcctagcacttggggaggccgaggtgggtggatcacatgaggtcaggagtttgagaccagcctggccaacatggtgaaaccccgtctctactaaatacaaaaaaaattaaccgggtatggtggtaggcacctgtagtcccagctactcaggaggctgaggcaagagaatcacttgaatctaggaagcagaggttgcagtgagcagacatcatgctattgcactccagcttggtcaacagagtgagactccatctcaaaaataataaatagtaaagattaactcatcctgtctccatcactcactgagacctgcctgttctcttccagcttttaagaagtacctgcaagaaacctactcaaagcaggtcaccagccaggagccctgacccaggctgcccagcctgtccttgtgtcgtctttttaatttttccttagatggtctgtcctttttgtgatttctgtataggactctttatcttgagctgtggtatttttgttttgtttttgtcttttaaattaagcctcggttgagcccttgtatattaaataaatgcatttttgtccttttttagacaagttgttgcgttgtaatttcactagggttggaggtactcagggtaggcagaggtggaacttaaggatgtggggccaagcaatggggtgacaaagatttattcccttgtaccttattttatgactctgcatctgtttcttcatctataaaatgagtgtcacaataatgcctcctgtctatggagtcggtgatgtgtaccagcaatgttagtgaatgttggagctccctcagctgtgttgcagatgaggctgagccagaccttaggctgaaacctactcctatagctgtagaaggaacaagcgtgtgtgttgggggggggatcccaacacacagccacccatgttctgtcctgaagaagaatgcttaggtcaccctaagcaggtccagggcctggggagacagccaggaaaaaagccccttccctggcaggactcaggtctgagctctggtctccaggctctagcccaggtccccggtggagctccacctccaagggggcacagtcgcctcctgctgcatatcccccagggagcccccagccccttgggctgcctctttcccctggcctgatgaaggctccagtctttgagcccctaggaggaaacacccctgctgaccagctgggtccccacaagggtcggcaggtggaagagtaggttgaagtgatagggcccccacaaagcccttcaggaagatctccaaggtagataagcagcatccagatgtgctccaaccttgcacccaactccttcaggtctgttagcagctggttggttgtgcaagcctgaagcgggaggggtttgggattggaagttgggtcccttcatgtctataattgtgctcttaggtctctcctcttgggttttttcttaatctaacattcatacaaatacacttgggatcttgttaaattcttttctgtaggtgtgaagtggagcctaagatccagtctgtttatttattttggtttctaaatagtttccaagtgatgtcattgctgcggtctgcttaagaacaaaatttagagcaatgttcttagaatgtggtccttccagcagcagcagcatcacccggaacttgttaggcaaattcttgaccccaaactgccctccaggttctgaaggtctcccacggttgaaaatcactaggttagcggatactggagaaaaccagagctcagaacctggcactaaattagtcaatatatgctggccagggccgggtgtggtggctcactccctgtaatcctagcactctgggaggcggaggcaggaggattgattgcttgaacttaagaattcaagaccagtctgggcaacacagtgagacccccatctcaaataataaattttaaaagaaaaataaataaatcttggccgggcctggtggttcacatcagcaatctcaacatcttgggaggccaaggtgggaggatcacttggggccagaaattcaaggttatagtaagcttatcactccagcctaggcagcagagtaagaccttatctctaaaagaaatgtttcgaatactaactgtggtggatgtgttttcatctgccatgtggtccttggtcacggtgtttggtaccttagatggccacatggcctgccttgggccagtcacaggtctaaactgtagttcagattcaactggtgttgtctggaattaatcactgggagagagtaaagttattttactaatggggttgctaaaagagaagggagtcagtctcagctgctgggggagcccgctgcagacggaagaaagccaagtagagacaaacagctgggagtcggagagatgacattaactgagactctggcctccagttcatgctttgccatcccagttcgataaactaacaaatccctttttggtttaagtccgtttgatttagatttctggcacttgcaacagaaagaagcctggtcaggaagtatttgaatttctggttattatgattcccattttattgaattcctacaagacaaaggccctctgcttggggctggggacaaaacagggaaaatacagctctgcccttaaagaggctggaatttgggggacagacaggcccatcaacagcggggactgcggaataagtgccatacagcccagttattaagctcagaccagtctgggcacggtggctcatgcctgtaatcccagcactttgggaagccaaagcgggtggatcacctgaggtcaggagtttgagaccagcctgaccaacatagtgaaaccccgtttctactaaaaatacaaaaaattggccaggcatggtggcgagtgcctgtaatcccagctactcgggaggctacggcagaagaatcgcttgaacctgggaggcggagattgcagtgagccgagatcgtccattgcactccagtctaggcaacaagagcaagactccatctcaaaaaaaaaaaaaaagaaaaagaaaagctcagaccaggtaagcagaactgtttcaggatcctggctccacctccatgttgcccgtaaacatgtaggcagttacatttaacctctccgtaaaatgaaaatactggtacctacctcataagacagtggaaggaccttagaacaatgcctggcacatagtaagcactgaataaatgttggtgctgaactcacatattgctatgtaagttcacaggtggagcacccaatagaataggagggtcagggaaaggtttttggagaaggaaattgagccctgagggagatgcacattccttggatagcaagaagttcaggagtatgtaaggagaggaatacagagctaggcgtggtggctcacgcttataatcccagcactttgcaaggctaaggcgggcagatcacctgagctcaggaattcaagaccaccctgaccaacatgatgaaaccccatctctactaaaaatataaaaattagccgggcatggtggcaggcacctgtagtctcaactactcaggaggctgaggtaggagaatcgcttgaactcgggaggcgggggttgcagtgagccgagatcacgccactgctctccagcctggctgacaagcacaaaactctgtctcaaaaaaaaaaaataatacaggatggggaagtcgcatagatgtcaggtcatgataggctggaaggccatattaaggtacttgggctagccttggtaacaaagtgagactccatctctacaaaaaataaaataactaggggctgagaagggaggatcacttgcacctaggagttcgaggctgcagtgagctataattgtgccactgcacttcagcctgtgtgatagggagattcagtccttaaaaaaaaaaaaaaaaaaaacttggactttatcttgaggcaacagccagctaatgaagccttgagcagggcagtgacgtgatcagattttttttttttaaatttattttttgagacggagtttcactcttgttgcccaggctagagtg[131 bp omitted]gacggggtttctccatgttggtcaggctggtctcaaactcccgacctcaggtgatccacccgctttggcctcccaaagtgctaagtttacaggcatgagccaccacgcctggcttatgttattttttaagacagagtctcactctgtcacccaagctggagtgcagtggcgcaatcttggctcactgcaacttccacctcttgggttccagcgattctcctgcctcagcctcccaagtagctaagattacaggcatgtgtctggctaatttttacattcttagtacagaggaggtttttccatgttggccaggctggtctcaaactcctggcctcaagtgatccgcctgcctcggcttccaaagtgctgggattacaggcatgagccacagcacccagcctccatctctattttaaaatatgtatatatttcaaaaaaaaaaaaaaaaagacatccaggtagaaccaataacaggtagatggcatcagaattaagagccttgttcccgtgcacaccacatagcacatggcgatactacctaggttattatctgggtgcctgtgtacttcacctccctaggccttagttttccaactgtaaaatggagataacaacatctgcctctagggatgttatgtgagtgaatgagacaatgtctgtaagacatagtatacagtaggcactcagtaaatagtaatgattaccaaaccccagcactgatcctggctggaaataaaaacagaaaaacatgaataggacaaaagaggaagagaaaaagacagatggagaggaagaactaaagcaatgagtaaggtgacaatagaggctgggcacgatggctcatgcctataatcccaacactttgggaggccaaggtgagaggattctttgagctcaagagtttgagaccagcctgggcaacatagtgagaccccatctctgctaaaaataacaaaaactagtggggaggggtcacccatttatagtcccagctactcgggaggctgagacaggaggattgcttgagcccgggaggtcaaggctacagtgagctgtgatcacctactgcactccagcctgggcaacagagcgagaccctgtctcatttaaaaaacaaaacagaaggccagatgtggtggctcatgcctgtaatcccagcactttgggaggctgaggcaggcggatcacctgagatcaggagttcaagaccagcctggccaacatggcgaaacctggtctctactaaaaatacaaaaattagccaggcatggtggtggacaccggtaatcccagctactcaggaggctgaggcagaagaattgctcgaacccaggaggcggaggttgcagtgagctgagatcgcgccactgcactccagcctggatgacaagagcgaaactctgttaaaaaaaaaaatgcttgctatgtgccaggcactgctgtaagcactttgcacacactaacttcttctcacaaccccgtgtttactatcactatccccattttacagatgaggaaactgtggcacagagtggtttagcttgtcacaggcagtgagcactcacacacaggcattctgtctctaaagctaaactacccctacacttaattagctgccatctgatacctgttgtatacgaattgctatggcagcaaatagccagtgagggcaaggttcaagggaggagatggtagttgagctgggtcttgtaggttgaagaatctgccagcttataagaaggacaagggcattccagggagggcaaacagcatgtgcaaagtaccaagggcttgaaaatgcaccccaggtccatatcaggaatacattgcccagtgtggctgcagccctgtgaggactatgggaagaaagagagggagggagggagggagggaaggaatttggatctcattgtagaagcagtgaggagccttgaactactttcaacagggcagtggccaagtcagatattttagctcgctgctgctgatggccctctgtagagcgcactggcagagaccaggtggaggcagggatctggggtcaaatgatgagatcagaatctccttagtgggtgcctccaccctcccctacaaccaccagtacaatttgaggagtaagcacttggaagaacagaagaagtaaaaggtcgagcagaaacaatgctgcctggcatggatgggcacctacttcccctctccccagctagggagcctgcagaaggtggcagctacgacaacatctaagacgcaaacgttccagaaaaggatggtggggaagtgagggagcttcccggctccccagggttctagcctctcccaccccctcaccctacctgccgtctcaggacccctccgcagtccgccggctcaccctgactcaactccaagcccctgcagcctcctggagccaccactgcctgtccgccaagctgtgcacgcccagcgccagctgtcaggagccggctgcaaacctgcagagcgagtcagcgccatcgagcactcgcagccgccgcctcgggctccagggcccagctcccttccacatcccgccgctcagacagcctctcccggggatccccaagggtgctccgggtggtgccagccgggatggcgccctggaccacagcccttgcgacctgctgtcctcggctctcccctcattcaggccacgagttttggaacatttgcttttattccttccagacaaagacccacaaggggtcgcgcctccctggtggggacccggcagggcggagtctcccacaccctagggacacgcgatcttggtagaggcgactgtccactccttactgcacgccctccatcatcttcaggaactctgagggaaaggagagggagagggtcaggggtcccactggggacgcagaggccaggccagggctccagccacacagaggggatgactttttgtttttgtttttgttgagacagagtctcactctgttgccaaggtcgccaaggtctgtcacccaggctagagtgcagtggcacaatcataactcattgcagccttgatctcctaggctcaagcgatcctcttacctcagcccccggagcaactgggaccacaggtgtgccaccacacctgcctttttattttattttattttttgtaaagacagggtctcactatgttgcccaggctggtctcgaactcttggcctcaagcaatcctcccacctcatcctcccaaagttctaggattttacagtcctgagccaccacgcccccctgcctggtcattaattgataaactgcacagagtcgtggagcgcttctatacctgcccccaggagactatggggaacttggtgaagttacgcccagcccagcccacaaggccaaggacactgcaccggagccaggcaccagtgcccgccgtcctctggggctcccacccgctcttcccaagctcccgttggccctcaccgtcgaagtcaatgcggccgtcgttgttcttgtcgccgtctttcatcagagattcgatctcctcgtccgtcacgtgctccccggaggccctgaaaatctcagccagctcctccgggtcgatgtagccgtctgcattccttcaggtccgagggacagggcagggctcagggccggggcgagctgccctggccaccacactcgacgccccgcttccgcactcccaacacggggaagcttccagcgctgccggccgggttctgactgctaagcccctccctcggctcccgggcccccagcgcacctgtcgaagatgcggaagcactcggccagctcctcctcgctcttccctttcgcgtcctctttcatctggcgcaccatcatgaccaagaactcctcgaagtcgatggtgccgctgcctgcgggcagcaggtggcagactgagcctgagcccagccgctgccgcctctccccaccatcccctgcctccgagggacacccgctcaccgtcctcatccacctcctcgatgatggcgtccagctcctccttggtgggtgtctggcccagcatcctcatcaccgtgcccaactccttgacgctgatgtccccaccaccatcagcatcaaacatgtcaaaggcagccttgaactctgcgagggagggcagagggcagaggtgaggcctgctggactgtcagcctcacacctacccccccccaacccccaccctgcctagaggccaacatgtccccagcatacatccacccagcccccagcctgccgcgcctcactcaccagcgatcatctcttcgctgaggtaggacctggcctcagcctgctggtccgtctgcaggagacacagagaaagtctgagctgaagaggcagccccagagcagttcctcacctcaaagccattcttcccaacccccactctgtcagcgcccttggttctccagaagaacaacttcaaacttgtcacataattgtgtgcccgcacagcacccaatcacagttttgttttgtctcgttctgtcacacatgctggagtgcagtagtgtgatcatagctcactgcagcctcaacctcctgggctcaagcaatcgtcccacttcagcctcctgagtagctgggactatagcatacaccacgcctaatttttaaaattttttgtagagatggggtcccactatattacccaggctggttttgaactcctgggttcaagtgatcctgccacctcggcctcccaaagtgctaggattacaggcttgagccactgtgcccagcttctgaccccagtttttgtttttgctttttgtttttgtgacagtctcgccctgtcgcccaggctggagtgcaatggcgtgatctcggctcactgcaacctccacctcctgggttcaagcgattctcctccctcagcctctcgagtagctgggattacaggcatgcgccaacacgcccagctaatttttgtatttttagtagagacgaggttttaccatgttggccaggctggtcttgaactcctcacatcaggtgatccgcccacctcggcttcccaaagtgctgggattacaggcgtgagccaccatgcccggcctgaccccagttttttttgtttgtttgttttgttttgttttgagacggagttttgctcttgttgcctaggctgcagtgtaatggcacgatctcagctcgccacaaccgcaacccccacctccggggttcaagcgattcttctccctcagcctcccgagtagctgggattacaggcatgcaccacaacgcccggctaattttgtatttttagtagagatgaggtttctccatgttggtcaggctggtctcgaaccccctaccttaggcgatctgcctgcctcagcttcccaaagtgatgggattacaggcgtgagccaccgcgcgcagcctgtgaccccagttttgagcaaaagagaggagacaacaagttaagcccaaggccttctcacttgtcaattgaaggccaagtcgggaaccccccccaccccccagtgaccttaggcacgtcaattagcgtgccttcatcttttctctgtagcttttcagggatgagatatcaggggtgtgaaagggctttgtaaagggctagcaccattccagcactattttccagttttctgcagctcctaatggtgcccggtactttaatagttgctcaataaaatgtttgttctcaaataaataataatgcaacacaaagttattgagtacttgctgcatgtcaggccacagatcaggcactggaaccacaaagaagagataaaagacacatcatcccgcccctcagagaactggcagagtcggaggctgtcagcttccttcttaggattcagtcattggagaaaaggcccctcatggggggccgaatgtgatggaggccttgacatgaaagtgagatttctgcaggggtttccacgtcatatccaagccaggccatctgggtcagaggctttggattgaggctggcagtgaggacagggtgaggcttccaaggagctcttcagccagctggccaccagtgctcctccttctccccctccttcctctcctcctctttccctatgccaggagggcaggctatttttagtcaggcatgggcaacagcagctggcctctgggatctagttactccttgaagtgaagtggggagggggatctcagaccaaaacaacagctccaaatcagaagccctctctaggagagcggagtctctctaactctggtctgtcatcttctgccccttcccatcatcctcagggctcccagagccctgcatctgagcaggccccacgccctgccggcctcccgtcttctggaggaggctttcttctctccatgatgataggagggtttggccaggcttctggctcacccctgccactggcctgctgggtgactcactctgacccctcagagtccccactgtgtgaaggaaacaagctaagagctcttcacaggtctatgaatgacactgctggaagtttccagaagtgagtaggcagtcagcaagccttaaggatcaatctctggaatatcccagccctcccctttcaagaaaagtcaaaggccttcctccaagacacctgggttccaggaacctccatgctccaacctcaaacatccaagttactgccccacagagcacccaggcctggcctgaaaggggtccagagtgctcccgtgagtaaaggcacaaagtcccctcttgtccttaccatggttgctggtgaccgggactcctctgttgcaggtcgcctcctttgcactccaccacccaaagatgacctggcctgctctagcccccgggatttgtaggggcaccctcccctcccacctccctgctccccagcactggagaccctgcccaatcagatcctggggtcagcgagtcccacccctcccacagtctgaacccattacctaatttagccaagggcccttgcagagaaatttaagcctccaagcaggtggcaggccttgacgtcctagattcttgtgaggaaggcctgccctgttccactgccttggagtccccccgaccgaggaagcacactggctccaagatggtaaggatgatcagagtagtaaagggtgaggcagcatggtaaaatggggagagtacaagccttgaagtccaaaacccaagatccaaggccagcctctgcgagttgtgtgaccttgggccggtagcagtgcctctctgagccatttcttcatctgtgggattggacctgtctgtggggtctccctcacagagagaccatggtaaatgggaacccgggtataagtcacctagcttgtgctgggtacacagcgttggtgcttggcaagaggaatgtcccgtctttgaaccatggtaaggggcaggggataggaggagaaagtgacaggtaggccactgtttactgaaccccatgacgtgccacacactgtgctaagcattttaacatgatctcatctagtgctcctcctatgaggtagcaacgattatccccacttgactgcagagctttgtaaattataaaggtctatactcactctgtcaccaaggctgatgtgcagtggtgctattatagctcactgcagcctctatctcctgggctcaagtgatcctcccacttcagcctcccgagtagctgggactagaggtgcaccaccacccctggctttttttttttttgtatttttatagagatggggtttcaccatgttgcccaggctggtctcgaactcctaggctcaggggatccttccaccttggtttcccaaagtgctagaattacagtcatgaggcaccatgcccacccatgttgatgattcttattattaatcctgactggagggaagttgggacagacagtccttggggcacctgtccagatggaaaaatgtatggagggatggaggagaggaggatgtgcatttggaggagaaataatcattgaaagcaaagatccttctctgaaagttaccttctccagggaaagggtgtttggattcactttttttgaagtaaggagtaggcaggggaaggttctttaagtggtaaaaggacagctggccccttcctagagctcagtgaagaaatctggtcatctggggagtaaaggggtgggcagaccaagtccagagggagcccaacctgagaatccacaaggtgcaggctgggcactggggagtaggcaaggcttgtagacagtggctacgtggacagaaagagcaccaagacaaccgatagcaggctctggggccaggaaaggggggctggacaccaaggaatgcagatggacagtggcaactgggctgcccccttcccctatatatagacattcccaaggaaagctcagcagggctgggccaagctaaataaggcctcccccaggcaggcagggtgccaaagggtgagggagacccatgggattccaatttagtttttattgttttttggttttttggggttttgtttttgagacagactctcactctgtcacccaggctggaatgcagtggcacaatctcggctcactgcaccctccgcctcctaggttcaagtgattctcatgcctcagccttctgagtagctaggattacaggcacataccactacgcccagctaatttttgtttttggtttttttttttttttttttttgagacagagttttgctcttgttgcccaggctggagtacaatggtgcaatctcggctcaccacaacctccgcctcttgggttcaagcaattctcctgcctcagcctcccgagtagccggaattacaggcatgagccaccatgcccggctaattttgtatttttagtagagacagggtttctccatgttggtcaagctggtctcaaactcccaacctcaggtgatccgcccacctcagcctcccaaagcactgggattacaggtgtgagctaccacacccggcaaattttttactttttgtagagacaaggtttcatcgaccgggcacggtggctcaggcctgtaatcccaccactttgggaggctgagatgggcggatcacgaggtcaggagatcgagaccatcctggctaacacagtgaaaccccatctctactaaaaatacaaaaaaattagccgggcatggtggtgggcgcctgtagtcccagctacttgggaggctgaggctgaggcaggagaatggtgtgaacctgggaggcagagcttgcagtgagccgagatcacaccactgcactccagcctgggcaacagagcaagaccccgtctcaaaaaaaaaaaaagtttcatcatgttggccaggctggtctcaaactcctgacctcaagtgatccgcctgcctcagcctcctaaagtgctaggattacaggcatgagcccctgagcccagcctttgttcttttgtttattcaagggattaggtaaggcccaaattgcttaatgtagccaagcaaggtcccattggcccttctaatctcactccttccctccacatcatgttgctgtctgctctgatcagactttaaaatactgctctaggctgggcacggtggctcatgcctgtaatcccagcattttgggaggtgcaggctggcagatcacgaggtcaggagttcgagaccatcctggccagcatggtgaaaccctgtctctactaaaaatacaaaaaattgctgctgggtgtggtggtgggcgcctgtagtcccagctacttgggaagctgaggcagaagaatcacttgaacctggcaggcgaaggttgcactgagccaagatcatgccactgctctccagcctgggcgacaaaaggagactgcatctcaaaaaaaaaaaaaaaaaaaaaaagactactctaaacaccaccttctatgaaccttcaagcctttgcacatgctgtttttttctgccagaaactcccatctttcctctcttcatctgtctacttccctatcatctttctaagctctaacatcacttcctcggggatccttcccccactgtgtccagaccagggagtccaaggtggtctctagtagtttcctcaatcatagcactgagcataccttatgctcacaacccattctatgttctacagatcatcacatttcccagtgctcagcacttgctatgtagcaggtgttcaacagatattatattctacataagaataactgaactggatggtatttagttcaatataagggggaacttcctaatagtcatagttgaacaataatgggaacaggtggcctcaggaggtaatgagctccgtatcactgagtatacccaaacaggagctagatgaccatttctcagggaggctgtagggagatatccatacagaatttaagaatgggggcagtggctcacacttttaatcctagcacattgggaagctgaggcaggtggatctcttgagcccaggagttcaataccagcctgggcaacatggcgagacgctgtctccaattaaaaaattaaaataaaacaaagaatggtgggtggtagctcatacttgtaatcccagcacattgggaggcagaggtaggaggatctcttcaggccaagagttcaagatcagcctgggcaacatgcaaccccacctttacaaaaaataaaatactagccaggcatggtgggcacatatctgtagtcccagatacttgggaggctgaggtgggagaatcacttgagcccaggagtttgaggctgcagtgagctatgatcgcacccctgcactccagcctcacaacagagtgagactctgtctctgaaagaagaggccgggcacggtggctcatgtctctaatcccagcactttgggaggctgaggcaggtggatcatttgaggtcagcagttcgagaccagcctggccaacatggtgaaaccccatctctactaaaaatacaaaaattagccgggtgtggtggcacatgcctgtaattccagctacttgggattacttgtaattccagctacttgggattacttgaggcaggaaaatcgcttgaacccaggagatggaggttgtagtgagccaagagtgtgccattggactccagcctgggtgatggagtaagactctgtctcaaaaaaaataaaataaataaaaataaataaaaaaggaagaagaagcaggaggaggaagaaggaagcaaaaagaagaagaaataataatagtggagaatgcgcaaccttcagatctcctagttctgactgtttatatgacccagcataagcccttcccctcactaagcctcagactacctatctgtaaaatggaggtgataggccagatttctgaggggccctcctgctctaacaacccatggtttcatgaagaccagctttgtgcccagacatgtaaggcatataccgaaggacaagttattttttaaccaatggttggtgaatgagtgagtgttgaattaatgaatgaagtatgccttttttgtcccaatatcttgcccataagccaaatgaagagtaattcgaggtttgaaattgtgcaaactggccaggcacagtggctcacgcctgtaatcccagcactttgggaggtagaggcaggtggatcacttgaggccaggtgttccagatcagcctggccaatatggtgaaaccccacctctactaaaaatacaaaaattagccgcatggtggcacatgcctgtagtcccagccactcaggaggctgaggcaggagaattgcttgaacctgggaggcagaggttacagtgagccaagattgcatcactgtactccagcctgggcgacagagcaagactctgtctccctctctaaaaataaataaataaataaataaaattgcacaaacttaggcttaaaatcccagcccctctatttcccagatgtggatcttggggaagtcactttgcctcagtttcttcatcttgaaaatggaccattaatgtccagttacagcctcttccccaggacgctgtgagggagagatgtgacagtaaagtgcctagagcaggatgtagaaagtggaccctcagaaaataagaaccccagcctttctgctcacatgggagggcagggagctgaaataccttctgcttatcccaaggcattttcccccacccttctctcctgtgccactcagaaagggtaggagctactttggagagattttgattttatttattgtattgtataactatcaaaatctgccctaacaactgatacctaggctttgtgacaggaagccacaataactttttcttgacctgcagctgccctgcggataaaagataaaacaaagctggggagccactgagattatcaggcctgctgcacaggaaaagggcagtatgcagcaggggacctgggctccaggccccatactcagaaacctctgagggaggcagaggcaggtggatcacttgagcccaggaattcgagaccagcctgggcaacatggccaaatcccatctctacaaaaaatacaaaaattagctgggtgtggtggcgaacgcctctattcctagctactggggaggctgaggtgggagggatgacctgagcccagggaggcggaggttgcagtaagcagagatggtgccactgcactccagcctaggtgacagagtgagactccatctcaaaagagaaagaaagaaagaaagagagagagagaaagaaagaaagagagagagagaaagaaagaaagaaacctctggcaagctgtgtggttaagccaagtaactcaccctctctggtcctcagtttccctgtttgcctacttcccatgtgtgaggttcaaatcagattgtgcaagcctgtgaacactgtagaaacaataatcattatgtaagtgatcatttcgtcagcctttgctctatgccaggcacgggacgagcgttcttacaagagctgcaaaattagttttagcagtattgttcctgttttacatatgagaaaacctaggctcagcgaggtcagattccaaccaacccaaatcacgcatcttctcctggcccttcgttttctctcgggagacatggcctccctactattgcataattactttgtgaagttaaagagcgttgggtggaaatgagtgggacagattggagatgacgtgggtggggtgggaggattcaaggagggtacgcgcctggccggactgggatgactctgcggcaggcctgggactccctcaggccgacccaggcttcccaagtccctcctggagccaagggcccgggattctcgggcggctcgggcgagcgggcggggcaggaggcggggcggcggcaggaagctgcccgagcggcgctctgagcggcctgagcccggcggagccctgcagaacccggccgacctccatgggctgcggggggctgcacccggacccctggggcgcggcgcgcccctgaatgcaccgtgggacgcaggaggtagaggcgcacgaggcggcgcaagagacatcgggagggtcctgagcccctccggggaggaacgcggtcctaggctgagtgggttggggggaaagcgatgctggctgggtcccctggttcgcaagacctcggactgccagggggtggggcctcaccgcgcccctccctctccggttcgggccccgcccctcctcctcctgcgccgggctggggtacccctcctccgggatccggtacacagcgtcgcgcgctccccccagggtgccatggcctcccggctcctgcaccggctgcggcacgccttggccggcgacggccccggggaggcggcggccagtccagaggccgagcagtttccggagagctcagagctggaggacgacgacgccgagggcctgtcctcccgactcagcggcaccctcagcttcaccagcgccgaggacgacgaggacgacgaggacgaggacgacgaggaggctggccctgaccagctgcccctcggggatgggacgtcaggagaagacgcaggcgagtgcaggaggacggaggcgggaaccctggggctcgattaggcctccatcccagccgcgttcccagagcatccagggcgctaagttgatccagctgaaactcccacacttcttaaagcgcctgggccacctcttggctgtgtgaccttgagagagtcttaacccccctctgagccaagttttcccttgtgtcaagtgggagaactcactctcatctcagaattgctgcaggcattaaatgtacagggcttgggatccgaatggaaatgatgtattaacgatattttgagggtggagctattaatttagcccctactgtctgccaggcacggtgtttggctcctcggtgcctctctgtccctcagtttccatttctgtaaaaagggggtaagtcctgcctcacactgggaggatgagtgaggccacgtcagtggttgatgtcgaccctggccctaggcccattgatatgactggtcatgtgtctgcagaacggagccccccacctgatgggcagtggggcagtcagctcctggcgcggcagctgcaggatttctggaagaagtcccggaacaccttggcaccccagcggctgctcttcgaagtgaccagcgctaacgttgtcaaggacccgccctccaagtacgtggtgagtgagggtctagaacccctgggctgtgagtccagaagtatggctaggagcaagtagggaagaccccaacttcctgaggggtctatgtagttataaatggttaccttgtttacaaatggggaaactgaggtcagaaaggggatgtaacttgagcaaatcctcacacaagacttagtttccttgagactgactgaagtggggattaaggaccttcctcttaacctggttttgagactaagagaactggtgtgtgcacttccccacccagcccacaaggtttttgcaaattgtagcaagatgtgagatacagagagacagatgttatctgggtcaaacttgagatccaagttgcatgggctggtagttaaggaaataggctttcgatccagaccaatcttgactcccacttatttccagttgtttgactctgggtgagttgtttaaccttggtcatcttccgtttcctcattatagcaatggggaaaatgcagaagattacagcaggagttaaatgagacaatggacaaaaagcccttagcagtgtgcctggcattatgacgtggtcaatgaaatggtagctatgtcatcattatttaactttgggttgaaaatgtttgtcatctagggcctgctgtgtccttataacgcacaggtcaatcagttctcaagcacccgaccttgtccctaagggctagacttagagggttggtggaggttaggatgaagagcaatgttggggaggaccttggagtcccttgctgttttccttgctgttgagagactgacttggagaatgaggtctgctcctttaatgcccacagcgactcctgctccagtcccttttcaggccaggcctgaaagccagctgagctggccactcctgtcagtggcagctctccatctctcactcccctcctcttcaccacccttctccacctctgactcagcaggagggggcctggagcccagtcccacatctgggcctctccacccttttctgttgctgttagtaagcaagggccacacccatggggtgactactccaatttcagcagggaccgactccgattattgagtcttttaaaaaaatttttgaggccgggcgtggtggctcacgcctgtaatcccagcactttgggaagccgaggcgggcggatcacgaggtcacgagaccatcctggataacacggtgaaaccccgtctctactaaaaatacaaaaaaatagccgggcatggtggcaggcgcctgtagtcccagttacttgggaggctgaggcaggagaatggcgtgaacccaggaggcagagtttgcagtgagccgagatcgagccactgcagtccggcctgggcaacagagcgagactccgtctcaaaaaaaaaaaaaaaaaaaaaaaaaaattttgagacagggtctcgttctgtcactcaggctggagtgcagtggtgcagtcataactcactacaacctccaactgggctcaagctatcctcccacctcagcctcccaagtagctaggactacagctgtgcaccaccacgtgtggccaatgatgaagtctgaagtggcaaaggtctcagaactctgggttcatacactggaaggggacaccaaggaatagttcagaggctgagaggaatgggggtgactgtgggtacctggatgggaagggatgacaagatagagcaggatggccaagtatgccccggcctgtgtctggagaagcaaggcacctcctgtgtacaatggggaccctaattccccactcaacttgtgggggtgaagagcacaggctttggaatcagatcaacctgagtttaaatcccagctgggctgttttccagctgtgtgacttacggcaagtctttgagcccttttccccctctttgagcctgcttcctcagctgtcagagataaggaccttccttgcagtgctgttgtgatgattaaatgaaatcacagatgtaaagagtgcttggtacaacaggaggcacagggtaaatgcttgggtaatggaactactgtcattatcacccatctggctgcatgttacaaggtcaatgagataatggatacaaaatgtaaactagatgaacataaaggcttattatatagaccagtgtgtcctgaagaaaactggtgtcctaaagtgtgtcctgcagaaaactagttccctggaatgttaatagctgtttctaaataaaggttttgcaggcaatatgttttgagaatgcagagttaaatgagaatacaataagtttctttattgttaaagtatttaatccctaatagtgatatacactgtgaatcttcaagaggacagagtaagcaaacctaactgaccaggagtggctagagtattgtcagttccacagaacaaatgtgagagaaagatctggatttggtgttagggtgcctttaacatctaacactggttaactctccttttaaacctgttggcttggcattataggttaatccatattcaggttctcagacctgggaggcggggaacttcgtgatcatcttgttcagtgttttccaaacctcagtcattccaatacctccctgattcttgtcctatctaaaaatgccacttgtgtccttttcttcttaacatttttctttaaatgaacctatttttttttctttatctttttttttttcttttttgagacagagtcttgctctgttgcccaggctggagtgcagtggtgcaatctcagctcactgcaacctccacctcctaggttcaagcaatcctcccgcctcagcctcctgagtagctaggattacaggtgcccaccaccatgcctggctaacttttgcattttcagtagagatggggtttcactgttggccaggctggtcttgaactcctgacctcaagtgatctgccgcctcagcctcccaaagtgttgggattacaggtgtgagccactacgcccagccgaacctattttttttcttaaataagtttatcgagacggagtcttgctctgtcgcctaggctggagtgcagtggcgtgatcatagctcactgcagccttgaactcgtgggctcacatgattctctgcctcagcctcctgagtagctgggaccacaagtgcccaactaattctttttctttttctttttcttttttttagagacagggtcttgccatgttgcccaggctggtctcgaactcctggccttaagctgttctcctgcctcagcctcccaaagtactgggattacaggtatgagccactgtgcccatcctttaagtaattttaaaagacaacttcatagcactaccgtacgtggaaagtctcacttgccaccgagagaagctagccataaaaataaaaggtgaggcacggtggctcacacctgtaatccccgcactttgggaggctgaggtgggcagatcacctgaggtcaggagttcaagaccagcctggccaacacggtgaaaccccgacactactaaaaatacaaaaattagccggatgtggtggtaggcgcctgtaatcccagctactcgggagattgaggcaggagaattgcttgaacccaggaggcagaggttgcagtgagcggagattgtgccactgcatgccagcctgggcgacagggcgagactaaataaataaataaagtaaataagtaagtagtgaaaatgaaacgtcattaaatcttgcctagatgttgttgcctgaaggaggccctgacctgagatccactttctgactcttttctaaaaatggagatgagaagtgttagagaagtactttttttttttttttttgagagagagtttcactcttggtgcccaggctcgag[141 bp omitted]tctccatgttggtcagcctggtctcgaactctcaacctcaggtgatccacctgcctcagcctcccaaagtgctgagattacaggtgtgtgtgtgagccactgcaacctgcccaagaagtcctttttttaaaaccaaactgagagctggccaggcgcggtggctcacacctataatcccagcactctgggaggcaaaggcgggcggatcacaaggtcaggagatcgagaccatcctggctaacacagtgaaaccccgtctctactaaaaaatacaaaaaattagccgggcgtagtggcaggcgcctgtagtcccagctactcgggaggctgaggcaggagaatggagtgaacccaggaggcggagcttgcagtgagccgagatcgtgccactgtactccagcactccagcctgggcaacagagcgagactccgtctcaaaaaaaataaaaaaataaaaaaaccccaacaaaaccaaactgagagcttctcaatttgtagtcagaaagattaaaaaacaattaggctgggtgtggtgctcatgcctgtaatcttagcactttgggaagcctagctaggaagattgttcaaggccaggagttcaaggccagccctagcaacatagtgagaccccccctcatctccatacaaaaaaaaaaaaaaaaatttttttaaatagctgagtgtggtggtgcatgcctatagtcctagctacttgggaggctgaggcaggaggaatgcttcagcccaggaggttgaagctgcagtaagctatgattgtaccagtgtactccaacctggccaacagtgagaccctgtctcaaaaaataataattaaaaggggaccaacctcctgatacagtgatatttactctagtgcacaccacctaaaaacctcaggtaccaatacttgtacatgtctcatttttggacaaacactgacttgaccgagcacttccttcactagaaacagaagtggacccagagggggactcccttgcctgggtcacacagagaaggagtagctgacctggggttagaacttgagtcctaggccagtatacttttcacagttatggcagttgtggctatctacagacctgtcctctgggtctagtttggaaaagcctgaccagggatgtggaggccaggtgtccaaagtggaacaagctccaagctggtcctaaaggagccccaagagattggctggggtttcagcttatgtctggttttccagagggggctgtcagaagaactaatgctctatgggaagggagtacaaaaaaaggggcagcagccccgggcactgaagctcatctctgtctttctctcttcttgctgccttgggcctgggtcatttcagacaaacctcaggtaagatgggactgggcttccccgccactgcgcagcagctcccgccctcctgggtgctgtcccaggggtgaaaggaagaggtggggaggtacagctgggagtgtgggggatggggaaggatggggagggaacgggcccgtggacaacttgcatttgccctgacacccaccctccctgcagctctacaccctcgccgtgatcggcccaggaccgccagattgccagccagcccagatctctcgccgttactcggactttgagcggctgcaccgaaacctgcagcggcaattccggggcccaatggctgccatctccttcccccgtaagcggctgcgccggaattttactgcagagaccattgcccgccgtagccgggcctttgagcagtttttgggtcacctgcaggcagtgcctgagctgcgccatgccccggacctgcaggacttcttcgtgctgccggagctgcggcgggcacagagcctcacctgtactggcctctatcgtgaggctctggcactctgggccaatgcctggcagctgcaagcccagctgggcaccccctctggcccagaccgccccctgctgaccctggctgggctggccgtgtgccaccaggagctggaagaccctggagaggcccgggcatgctgtgagaaggccctgcagctgcttggggacaagagcctccaccctttgctggcaccctttctggaggcccatgtccggctctcctggcgcctgggcctggacaaacgtcaatcagaggctcggctccaagccctgcaggaggcaggccttacccccacaccaccccccagtctcaaagaattgctcatcaaggaggtgctggactaacccttgcctagatttaaggccactgtgaggagaggggttgccccagaaggcaggggaaggacctgatgagaacagaatagctgggaggctgcagagggtgctgggagcccctagaagttccaaaagagaatgtgaagcagatcaaggaaacttctgttgagctaggctcagggtgagctttggctggggttgcccttgtgtagtacagggaagtctgacacagcctctccagcctataaacagccggggggctgtggcacaggttggggcaatgttcccttgttggtgggcccccaagctggcaaggcctcttggctgaaggccagggactctgcccctggagtcctggagttaagggatgaaggcaaggctgcaggtctggcccaggggaattaaaagccagccactccagtggtatcagtctctttattggatgtgagggccaaaagggactgtaactcctgtctcaggaatggggatagatgggaggttcttgaagccccaggcgaagctggtacctctggctacagcttgctctctgagacctggggcttcactcggatcacgccctcctgggcacaggtcacagctaggactccatcctgacgccacagccgcccatggaccagcccccgagagccacctgtgggtgaggtgaagggtgatgatggcctgcttcagaacagccaaatacactttttttttttttcctgaaacagagtctcactaagttgccaggctggtctcaagcgcctgggttcaagggatcctcccgcctcagcctcctgagcagctgggattacaggcgcacatcaccatgcccaacctccaagtggacttcttgcaaagggtctggcccagggcagggctgccccacacaagggtgcactgagtgtcgtggctgctccaaatgccccttcatgagcttattatggaccgtcattgaggggtaactcctcccacaggaaccccagttgacagtttaaaagcactttcacacctctcctcgcttcctcaaaaagatcacagagggaggagctctgagaacagtctccttcaacagttcggccaagcagaactgctgtacctctgaccacttgtgttaggaaaactatcggctccctgtataataaatcaagccaggtcctccaagtggtaattcatgaaaaatatccccactaccaccaccaaggggaagaaaggactcagaagagaggacttgaggccatgaggtctggcctcttccctccccatctggagactctttctcccttgctggctttgggcccaagtttgatgtttatgaggatgattgctggtttcccttacacatagcagagctcactcagttctcacagtagccaaatgaagcagttatgtgttgtccagttttccagaccaggactgaaatccagagagggtcaggaatttggccccatgatgaagccaaatctgaacccatgtcctcacttcaaggttatcaatcttggattgtgatgctattggtacttgagaataccccttatctgagtataaagaatccttgagttttgtccttggtttatcaagcaaagcttttcttcatttgaaatgtactcccttggaaaggaggtcagggttctgaagctagacattgatgaacgagtcttgtttctctcccctgcaaggaaggtccaagcaggcccttagggaccactgaatgccccgatcccaatcaggttaatcagaatcacttagagaacttaaaaatacagtttcctggaccttatccaagacctactgagtgagaatcttgagggtggaatcagaatctattttgaaaaggcatccccaaatggcagtctgatggactgcgggtttggataccactgctgtaatgtaaccctctttgtttagatgaggaaactgaggttcagatggaagatatgatttgcctattgtaatacaaagaatctgaactggttttgggactagaactgggtccctgggagaaggtgaatcacatttccagcacattctagaaatttagagcagagcaggtgtcccggcctcaccctctcattttgaagatgaagatgccaaagcctgggagggaaggaaaggaagtgacctgtgcagcgccacacaggaagtcgggaaatcagcatcacccaagaaagcaggctcctgccactcaaggtcagtgcccttgtcccacacggccccacactcaccggcccaggggctctcgcattcatagagcatccagtggtcagctcggaagggggcgtggaaccacatggaatggtccagtgagaccatgaagtgcaccttgtgctgccactggtgaggcagcagtgcagtgcccaagaaggcatagtcggagatataggcggccacgcagcagtgcatcttcatgtcgccctcgcctgcaacaggtccccatcagccctgggctcctgggctttccagctcaggacctgcacggaggtagggggaaaagggactcccgtgcatgggtgtgcagactggttgctgcacaagagcgcttggcctacagtgtgtgtgtgtgataggggagaagtgagatggcgacttggggagggcaggggtgagcagggactgaaattcagtcttcaccacccaagtctcccactctaggccccaaaaggggtgtcttcttccaatttgcacaaagatactttatagttagcagcaaagctggacaacaaccccagcgaggtgccttttgccttcctcagaaaggccttgtgtcgggattatagtcatctccaccttctccccatgcaaagggctgagagggcccaggtgagaagctaagccaacttccccatcatgcagataaggaaacaggcccagagaagggaactcatgtgcccaaggccacacagcaaatgagtggtagaccccttggagagtggtttcctcccatccatggggtactcttaccaatatagccccgggctcgcacccagaacatctgtttgggctccattctctgcagctggctcaggggggatgggtttactggcttgatctcaatggggacctcctgagcagcaattcggttgagcgccaatgggtacctcttttggaggttagggtccctgaaagtaaagggaagagggtcggggtgagacccaggaagagagggagtcacatctgcattgcctcttctgactcccctcattcttccacagggacccctgatatccccaaagctcccctcccctgtggcaggcaggatagtgcagcgtttgaatcccttcttggccacttacgagccatgtggtctcgtgctaattagtaatctgagtctattttcccatctgcaaaatgtggataatgatagtaacctacctcataaccaacactgtgaagacaagatcatgaatatctaaccaacacatcatagtaataaggcataccctgtaatatgcactgttctaagcattgtacatacaatagtattcctcacaacaaccctgtgagataggtactattatcacccccatttcatcagtgaaataagcacagagtccaggtagcttgcttaaaaattggagagacaggatttggactcaggcaatctgggtccacagtatgattattttctatttttttagagacaaggtcgtcttctcacccaggctggagtacagtggcgcaatcagctcactgcagtctccaactcccaggctcaagccatcctcttgccttggcctcccgagtagctgggactagaggtgtacgccactgtgcctggctaacatttttattatttctttattttgagacggagtctagctctgtcacccaggcttgagtgcggtggtgcaatctcagctgactgcaacctccgcctcccaggttcaagtgattctcctgcctcagcctcccgagtagctgggattacaggcgcctgccaccatgcccagctaatttttgtatgtttagtagagatggggtttcactgtgttggccagggtggtctcgaattcctgacctcatgatccgcccgcctcagcctcccaaaatgctgggattatttttacttttttttgtagagatggggtctctttatgttgcccaggctggtctcaaaatcctggccttaagtgatcctcctacttcagcctcccaaagtgctgggattacaggagtgagctgctgtgcccagccacttcattattttaaacactcaagaaacaggctgcctgacttggcctgagttaccaaaccctacacagtagggaacattgcatccccccagggggaggagcccattccaaggaactcccttcaatacagtgacaaccacccatagtgctctgcacaggtcctgccattttcacccctatcctctggagtgctgttggacagaacctcctatgatgatggaatgcctatctgcacagcacactatggtagccactagccacatgtgactatggagcacctgaaatgtggctaatgcaactgaggaacagaattgttcattctactgactttggtttttttttgtttttttttttttaagacggaatctcgctctgttgcccagtcaggagtgcagtgactcaatcttgcttactgcaacctctgccccctgggtccaagcgactctcctgcctcagcctcctgagtagctgggattacaggcacgggccaccacgcctggctaatttttttgtgtgtgtatttttaatagagatgaggtttcaccatgttggccaggctggtctcaaactcctgaccttgggtgagccacccgccttggcctcccaaagtactgggattacaggcatgaaccactgcgcccggacctatttaattttaattaatgtaatatagccacgagtggctagagactaccttattaacagcacagatctaaattcaaggtcctttaacaatgtcttcctttcatttcagcaaacatttgtcgaactgcaaccacacaccaggccctgtgttttttctgttaatagtgatataactacaattcactgccattgtgctagttagtactagcacgctaagtgccttttctctcttatttaatcctcacagcagccttatgaggtaggaatatgattagcaccattttataatggtgagtactggctcagagtgggaaagcaacttgcccaaactcacacagctagtagggacaaaatctagaattgaatccaggcctttcaggttcccaaacccacatccatcccgtcatactctgctgcctccccagtatctaacacgagatagagacattctctccttatgatacagctaagaagtaggcagggcagaaatgagcattcccattttttagaagaagaaactagggccctggggagttgggcactgtcccacagcaggtgagcattcacagaggcacagccctggacagaatccatgtgtctatcctttgtctggacccagagctctttcccctgtaccagcatttttcaaacttgattaggtgtgatccaaataaatatattttaccaggtattcaaaatatctaacatgctccctggtggtctaatggttaggggaaaatacatatttgtatttttgtacatatgttttatatacataaaacatgtggccgggcacggtggctcacgcctgtaatcccagcactttgagagaccaaggcaggtcgatcacttgaggtcaggagttcaagaccagcctggtcaacatagcgaaacctggtctctactaaaaaaatacaaaaattagccaggcatggtggcatgtgcctgtaatcacagctgcttgggaggctgaggcacgggaattgcttgaacctgggaggcagaggttgcagtgagccgagatcatgccactgcactccagcctaggcaacagggcgagactctgtctcaaaacaaacaaacaaacaaaaacatgcactaatgcaaaggcagtgaccaaacataggccatagcgctgcagctctccagaggacactcactcctggtgtgcattaagtcctaagttgctggaccaggggcctgggggagagagggaatcacttagggggctggggaggtggtacttaacaagtggttacggaagtatttctatatacatatatatataaaatatatatatggttttttttcccaggtatggtggctcatgcctataatcccagcactttaggaggtcaaggtgggtggatcacctgagatcaagagtttgagaccagcctggatagcatggtga[132 bp omitted]tgtcactgcactccagcctgggcaacaagagcaagactccatctcaaaaacaaacaaacatgtatatatataaacaacaacaaaatatatattctttttttcttttttcagacagagtcttgctcttgttgcccaggctggagcacagtaacacgatctcggctcactgcagcctccacctcccaggctcaagtgatccccccgcctcagcctcccaagtagctgggactacagacacatgccccgacacccggctaatttttgtattttttatagagacagggtttcaccatgttgcccaggctggtcttgaactcctgggctcaggtgatcctcccacttgggcttcccaaagtgttattataggtatgagcccccacacccagccccagccttatttttaaattagagatggagtcttgctatgttggcgaggctagtatccaactcctggtctcaagcaatcctcctgccttggcttcccaaagtgctgggattataggtatgcgccactgcacccggccaagcccttcattttataccatgacccagtacagacacacaccagaaacacacatgactaaacctcaagtttcacaaaaggattcttgcccttaatacatacatattattcactccagtatcttcttttctaatctgtattttaaaaatgctggtcaagacccactaaaggattctatgacccacaaacagatagcagctgcattttgaaaagtctgccatggagcctccaggtctctcaccttaaatactggtcaatgagggtctcacagtcaagcagctcttctggtggtggcacagtgggcatggagaactggtgctgcatggggctgggctgggcctgctggaaggaggcctggcagatgaagatgggcttcccatgttgcacggccttcacagagcgcaccgagaagctcgaccctgttcgtgtccgctccacttggtacagtactggcagcttcgggtcccctgcagtgggcacaaggacacagtgggtccacaggccctgtcatcatcacaacgcctgacaggcactctactactcatcttccattccatttcatctcagtgactactaactgaggtctgctaaggtccaggcccagggatacagagaccaccaggccctgtcatcaggcttctccctgtgcaggtggagcttttctctaacagcacaaacagcagagacattgacagattccttgcattcaaatcctggctccaccactcaccagccgtgtgacccttcacttctctgagcagtgtgcttatttgcaaactggggatcatcatggtgctcatcgcttacaggattttaatgataatgaaatgaatccgtagttgtaaagtgtttagaataatatctggcacatagtgagggctctatatgtgtttgttaaataaaattaatactccttgcttctatcttgctccatctatgcctgggatcttgtcatcagtccaaaaccattattctagatcagggagcagtaaatctagcctgcagcctgtttactgtttattctgttgttgttttcttttttgagaacaaacaaaggctatttattcagcgcttgttcttttttttgtttgtttgagatggagtcttgctctgtcacccaggctggagtacagtggtgtaatctcggctcactgcaacctccacctctcaggttcaagcgattcctgtgactcagcctcctgagtggggggggactacaggggtgcatgaccatacccagctaattttttttttttttttgagagacagtttcgctgggtcaccgaggctgaagtgcagtggcgctatctgggctcactgcaacctctgcctcccaggttcaagccatgctcatgcctcagcctcctaagtagctgggactacaggcgtgcgccgctacacccaacaaatttttgtattttttgtagagatggggtttcactgtgttgcccaggctggtctcaaactcctgacctcaactgatccacccaccttggcctcccaaagtgttgagattacaggcatgagccactgcgcccagccaatcagagcttgttgtagcaggaagtcaaccaccatcacttgcttttggcagagacttagaggcaggcaaaggaatgggaatgctctgtagtggaaaaaaaggcttcagggatgctcccattgcaggctgttggcatggggaagctgttggtgggctaactagaagcatgacacctggctgggcacggtggctcacacctgtaatcccaacactttgggaggctgaggcgggcagatcttctgagaccaggagttcaagaccagcctggccaacatggcaaaaccctgtctctactaaaaatacaaaaaattagccaggcctggtggcacacacctgtaatcctagctactcgggaggctgcagcaggagaattgcttgaagctgggaggtggaggctatggcaggagaactgcttgaacctgggaggtggaggctgcagtgagccgaaattgcaccactgcactccagcctggggaacaagagtgaaactctgtctcaaaaaagagtgggacatcctatgtgattggttaggagtacatatttggctttctccggttggtcctaagttggaagcaggggcaaaaattagggcagctatcagttattaatcaagtcctggctttggaggccaattgttacagtggtcattatttggcttgctggactggttggtaaagatagtggtctgacttcctacaagtctgacttgtggatagtaggctggcttcctgtgctggttgctgctattgtgcgtcagagttctgtttttctacatggtctagccattgtctgtttgtatattcagcctctcccaggcaagggccactgtcagtcacttcacccctgatgtatatggaagccatttggtccttcactgtcaggtgtctctgctccaaagcagagtggaagagcctaggcaacacagggagaccctgtttctacaaaaaataaaaaataaaaattagctggacatggtggcatgtgcctatagtcccagctaatcaagaggctgaggcggaaggatcacttgaggccaggagatcaaggctgcagtgagccatgactgcgtcactgtgctccagcctaggtgacagagcaagaccttgtctcaaaaacaacaagaccaccaccaccagagtagaaggcactggccagggataaggcagccaacaacaagcaggtgagggaagatttggagaggaagagaacttccctggtttccctgaagttctcactttgtctgagtcaggctgaccttgaggaaccctgacatctgggccatgagacatcttggggatgactttcaaccttcagatgaaagaagcaggtctagagaagtgttgcttccttcactctgatccaaatggggagtcaaccaggcaccagggctcaatcaacagcaataaacatcactgtctgaggtcaactggcttgctcagctctctgttatcaggcactgccaccagcagcacttctatcagagtgcgagctcctcaaggttaaaggcatttgagaagggcttaccaagagtccagacactagacaaagttacttgtgcagtctgctttcagacactgggaatgaagtcttcctccctaccaccaaacttggggggaaaaaacaaaaaaaaacctctaatccaatccttggtctgcaggtaagctaaagtgcagattcctgaggaggatcacagaaacttcagtactctggtctacctttcagtgtgaatgagttccagccctattcttgaaaattgttattggaacagagcaggtaggccctgaggcatattgaagggagttaatgattatggagtgatgcagggtgcctgacagcattggacaggagggtatgttttctcatgttggtctcacaataactatgtagagccactcttacccccattgtacagatgaggaaactgttgccttaaaatacaatttttttgtaataaagtcatgctaatttgtttacatattgtctatagttgctttcactggcaaaacctaaaatgtttactatctggccctttctagaatgtttgctgaccttgttctgaattcttcaagctctaaatttacctctgtagagaaaaactaaaaacaaaacaaaaacccaactaattcacattctttcctgggcttttagaaaaagaactgatttgataaatggccaaggaccaaccctccccctcccccataacatcttttatttttaaaatgtaattgaaacatctcttttttgttttgtttttttgagatggagtctcgatctgtcgcccaggtgggagtgcagtggcgcagttttagctcactgcgacctccagccgccgggttcaagcaattctccttgcctcagcctcagcctcagcctcccgagtagctgggatcacgggctaaggtcaccacgcccagctaattttcctttttttttttagatggagtcttgctctgtcacccaggctggagtacagtagcacgatctcagctcactgcaacctccacctccagggttcaagcgattctcctgactcagcctcctgagtagctaggactacaggtgtgcaccaccacacctggctaatttttgtgtgtgttttttttttttagtagagatggagtttcgccacattgtccaggctggtctcgaactcttgacctcagccgatctgcccgcctcggcctcccaaagtcctgggattacaggcataagccacatgcccagccaaaaaacagcattggttttaatatctgatatagctggcagagtcacaccacaaacagataagagctctcccctttttgccttgcagccaggaagctcagaactaaaccttgtatgaaactgcaacaatatggcttagccaaattttttgacatgatcgcttctcccaaatcccattactactggcctaatgtcctttgacttttaatattcccataataactaccaattattttagctatcttgcagcctttcaagacacaagcaagggcacaaataattatttttatttatttatttatttttgatggagacaagagtctcgctctgtcgcccaggctggagtacagtagcatgatctcagctcactgcaacctccgcctcctgagttcaagcaattctcctacctcagcctcctgagtagctgggactacaggcacatgccgccatgcctggctaatttttagtattttagtagagactgggtttcaccatgttgcccaggctggtctcgaactcctgagctcaggtgatccgcccgcctcggcttcccaaagtgctaggattacaggcatgagccaccacgcccggccaaataattatttattttgaaatggtggcttggacacagctcatttcacgctgctcctggatgaagactttccaagaaagaggatcttttccccagaacctgggatgggtaccctggcagctctctcattgtttagaattattgcccaagagcgaagcaaagaagcaggaaagagtttggcactcaaagacacataaaccaggttcaaatcctggctctgcctccttgggcactgtgggagctggttccaaacctcttcaggtcccagtttccttaggtaagaatgatggcaggaatgcctgccacccatgtttacttatgaagactaaacaagataatgcacacaactatgctctgtatcatgcaaattttaattattcccataagttaatcatcaaaaactaataatatttatggaaaactagattatgccaagccctgcactagatactttactggcaaagactcattgaattcttccatcacaggatgaagagattcagagttcaagtaatgcccccacccacacaaaagaaaacagccaggtatttcactaggctggaaggattacaatatcaaaaggctggtacttacaaacaaattaaagaaacaaagcacatatttactcccaactagcataaagataagaacctggctgagcccaaggtaagtattcaaatactttatagcagtgactgggggccgagaagaggggggccaatcaatactcctcagggatgaggagtaagagacacgggacagtatgaaaaagtgtatttaccattacagggataactttcatatttacaaaatgaagggggaaaccccatggttttcttaatacaaatcacatactgtaaaggtccacaaactcttctcagctggggatctacgcagaacacatgagggcatctgctctgggggtaacagggaaggaaagaaaacagtgagggttttttttgtttgttttttagcataggttttgcttttattttccttttatttatttttttgtagagacaaggtctcgatttattgccctggctggtcttgaattcctgggttccaacaattctccgcattggcctcccaatgtgcggggattataggcatgagccaccacacataggttttttgtttttgagacagagtctcgctctgttgcccaggctggagtgctcgcccaggctggagtgcagtggcacgatcttggctcactgcaagctccgccttccgggttcacaccattctcctgcctcagcctcccgagtagctgggactacaggcacccaccaccacacctggctaatttttttatatttttagtagagacggggtttcaccgtgttagctaggatggtcccgatctcctgacctcgtgatccgcccgccttggcctccaaagtgctgggattacaggcgtgagccaccgcgcccggcctcacacataggttttaagttacattatctgaccccagagctgtaagaagctgtagagatcatcccactaaaatacccttggtcccacccttctccattttacagctgaagtaaaccaaactgtagggcggggaggtaacctcacaaggctgcatggtaaattatggacaaaactgaagctaggccctacatctttggtttgtttttattgaccctatgctcagttgacaaaagaagccttagatcccttgactctcaggctggtgctctcttctccaacccaagctgccctacctccacacctctagcacagaggtcacagcacactgagaacctagcacagcgctccgcaccaggagctatgttaagaatggaagaacaaaagcccacaaggagcagttaagcaacaaagtcttgtgtcattatcagccagacatcaggtacccagtgagtcccagcaggtgtgaggtccaaggctcattgttagccccagacctcgttccaccctagacacctcttagggtggtagtgtccgccacccctccccttgtcttccagtctccctctcttcccttttgacctcagcccccaaggccagaaatggctgctgggccaccagggttgggttggggcaggaagtggggggtttacctgcccgaacaaagtagcagtgcagggagtgcacgtggacgtcttcactcacagacttggctgcagccaccagggcctggcccacgatctgaccaccaaacagcctcttggccggtacccagtaatgccttcctctgtagggagagggggaaagagggaaagacttgggaactgggccaaattctactaccctcactaagactctaatgcatgatctcttcaccatattggggtttaagatccttttgagaatatggtaaaagccataggtcctttccccaggcaaatatccttatgcataaaaatcctctgggccgggcgcagtggcttacatctgtaatcccagcactttgggaggccgaggcaggtggatcatttgagatcaggagttcaagagcagcctggccaacatggtgaaactccatctctactaaaaatacaaaaattagctggacgtggtggcatgcacctgtaatcccagctactcaggaggctgaggcaggagaatcacttgaacccaggaggcagaggttgaggtgagccaagatcgcaccactgcactccagcctgggtgacagagcaagactccatctcaaaaaataaaattaaataaatgtataaatgaataaataacaagagccctcagacatcaagtctaactccttcagtgtacagatgagaaaactgcagcttggccccagagatgaaaatgcttgcccagaatgtaggcccattggaagctgaataattatgtctctagcctcccacgtcccagctgtttggcattttctgtaacaatgagttatgaacagccctccatgacctggcaggtggctctcgcctgtaatcaatcccagcactttgggaagccgaggtgggaggatcgcctgagcccatgagttcaaaaccagcctgggctccaaagtggggcctcatgtctactaaaaataaaaaagttagctggatgtggtggcaagcgcttatggtcccagctaaacgggagactgaggcagaagggtcacttgggcccaggaggtcgaggttgcagtgagccatgttcgtgccactgcactccagcctggacaacagggccagatcttgtcttcaaaaacaaaaatcaaatagccctccaagaagttatttacaattccttaagtggaaggaagggagctcaaagtaagataacttccagtaaagccaggagaagccttggaggtcaaagctgttagaagccttgctgcagggggctgggcgcggtggctcatgcctgtaatcctagcactttggcagaggtgggcagattacaaggtcaggagttcgagaccagcctggccaacacggtgaaaccccgtctctactaaaagaagttaaaaaattagctgggctgtggcgcgcctgtatgtcccagctaatcaggaggctgaggcaggagaaatgcttgaacccgggaggcggaggttgcactgagccgagatcgcaccactgcactccagcctgggcaacagagcaagactccgcctcaaagaaagaaagaaacccttgctgcagtcaagaacttcagcgatgctgggaaagaaaaaaacatgcttaggcctcagaataagtaatgagaaaccagacccaccaaatggtactgggggcgggatattgtgagaagaaaaggatactgaagacacaaggagctgcggcgtcggttttaaggctgatccatcagctgtgtgcccttgggcaaatcactgccctctctgggctagctcccccgtgaaggcttagggcaggctgccgagcagggtctctcaggtcaccactatatttgctcagctgtgcagacctcgcagcgcggagaggaagggaggaagccagagcagagaggacagctctgttgggggcgagttctctcctaatcgtggcagagggtgcatcccacgcagagccatactagtcccggagccaggggccccgggcggcggcagtcaagatcaagtttctgccctaaaggaggggatgctgggcaggagctgccggctacctgaagagatcctcgtccagcggctcgaggttgagcacggtcgtgaccaagacgctacggaggtccccagggggatcgccgcggtcgccacagccctgcccatcttctggggcctgcggggacgacatctagttcaatgctgcaggccctgcacacccgctccgcggaagacgcggagacatacacagaacctgactcttccggcagattgccctagtaaccggaagtctcctgcagaccccgggaaggaggaatctaggttatgattggtcaggactcctgtcagtccgctggtggctgtggccctctttctctagcaattggagaaaatgaatgccaatctgcgaatcctgtgtgtgactggatatgtcgctgaggaggcggaacctcgggactggataatatggactgagtgtcatttcccctgtcagatagcaaatacacccccttcctcttgtaacccggtcaggcctagggttcctccctgagttccagaataggccacccagttggggcggacccttaaggcattctgggcccacgcctgcctataaaccctcatagtgtgacctttgacccctggtgtgatcttgggcccgggctgggaccagcccctagtgtgggttgtgggggcggccatggagctgggcagctgcttcaagacctatgaggacttcaaggagtgcttcagcgcctacaaaagggagaacaggtgctccttcattctcagggactgcgtctccgtccgcttccacaacctcaaccatggcacctccatccgcgaagacatcctgtaagggcgggcggggcggggcgggccaagagggtggggaggaggctggacctccggagggctgcctggaggaggaggggtgcataggcacgcattgggctgcgtggccattcattcaacaggcactcattgagcacctgctgtgtgccttgtgaagagagctaagcctccacggccattggtttttgaccacccactccactttcactccattcacaggcttttctggaatttataactgcagtttctcccattgttttgagcagctgcagcaacccaaatacaaagtatggctttcataaacggataaaaacaccttggcgataatttccttcatcagtctcctctttacaaaacagtcacatggtcgttggaatgttcgttcattcattcattcagtttttagttcttatatatttgttgaaacagggtctcactctgtcccccaggctggagtgcagtggcacaatcagctcactgagccttcaactgctgggctcaagcgatcctcccacctcagcctctcaagtagttggaactggaggtgcacgccaccatgcctggctaattatttgattttgtacagactgggtcttgttatgttggctaggctgttcccagactcctggactaagcgatctttcggcgtctcaaagtgttaggattacaggcatgagccactatgcctggtctattcattcattttgtaaatggtttttgagctccttatattaaccgttttcaaacactttccatgtgccaggcagtgttctctatgcatgctttaccctgcagggcttttttttcagaattatagataaatgttatttttttgcatttgacagatgagaagatttgacagatgagaagtcaggcttagaggttaagacaggagttgaaaactcaaatgccttcagggattaggtgaaacaacccaatgtaagaaagttttaactttgaattttactttaagaaaaagaatgatgaaatagcaaccaacaccaggtctttgtgctagggacaacagaagtgtgaaatgggccaaatggagagtagatgccatctaatcagctccagctgatggctgccatatgaaaataaagatctagtgttgccagaattttgggcaagagttgtcagaaatccacactttatgtggattttcccatttaaaaaaattgaatcagttcaaattttaactcagagcatgcgggccaactcagagttaaagcatatccgagtttgagacttggattgagatgctcaaccaaagctcctcaattagacagccaggctatattctttccactgttctgaagtccagtgctatgctgggtataggtgacataaagatgaataagtgttcaaactatccccagagaactaggataaacttgaactcaagcaaactggtgtgtgataaatgctttaaaaggaatgtggaaaaaaaaaaaaaaaaagaaatgtacggagaaagaaatgaatgacaaatgcctgggaggtgggggaagtcttcacactggaattgatggtttccctgggctgtgaatgaatgtagagtgctagagtagatctgtggttaattactgagtaccatggaggcatttgaccagaagttgctgtgcagaaggacctacaggagcaaagacaaagatacatgaaagaaggttggcatgttagagtaacagtgagggataccatgtttggcaggagatgaagtcatttgcagtctaagggtctttagggaccattgtgaggtgtttggaccttgtcctttatgggtaggaccttgctaagcaatgagaggaatacaaaaaaaaaaaaaaaaaaaaaaaaccacagttgcccgtaaacacccttcaggaagaccatctcaggtggctagcacaaggtgtggcccatagcaggcattaaataattattgaatgagtgagttatcaagtactaaccatgtgattcagggaaataggtgctgcgggaactcagaagagaaaaatcactgcgagctagagacgtaagagtgaaagggaggcttgagctgggcccccaaagatggagagctgtcagaaggtgtattggttttctgtttgccactctagtgaattaccacaagtttaatggtgcaaagcaacacaaatttattatcttagagttatttaggttagaagtcaggcacaggtcttagcaggctaaatcaagatgtctgcagggctgtatttctttctggagtccctgggtaagaatccatttcccgccgggtgcagtggctgatgcctgtaatcccagcactttgggaggccaaggtgggcagatcacttgaggtcagcagttcaagaccatcctggccaacatggtgaaaccccgtctctactaaaaatacaaaaattagctaggcgaggtggcacatgcccgtaatcccagctactcaggaggctgaggcagcagaattgcagccgggaggtggaggttgcagtgagccaagatcgtgccattgcactccagcctcggcaacagagcgagactccatctcaaaaaaaaaaaaaaaaaaaaaaaaagaatccttttcctttccttttccacctcctagaggctgcccaacacaccttgggtcatggcccccttcctccatcttcaaagccagcagtagcaggttgagtcatcacatcactctgaccttgcttctgtcatcacgtctctgactccctcttctgcctccctcttccacttttaaggatccttgtgattatattgggcccacccagataatcccagataatttccctattttgaagtcagctgatagccaccttaattctatctgcaaccttaattctcctttgccatgtaacctaacgtattcacagagtctaggattaggacaaggacatcttcaagggaccattctgcctgccacaagaagattaataacctggaggtaaaaatggtgtgagtcagtacagacgtaaacatgacgtgcttctattagaaaacagtgatgggctgggcacggtggctcacacttgtaatcctaatactttgggaggctaagacagggagattgcttgaaatgaagagtttgagaccagcccagactataatcctgggcaacaaaatgagatccccgtctccacaaaacaaaatttaaaattaggggccaggttgtggcagctcacacgtataattccagcactttggtaggctgaggcaggcagatggcttgaggccaggcattctagaccagcctgggcaacatgccaaaacctcatctgtacaaaaaatacaaaaagtagccaggcatagtggtgtgtgcctgtagtaccagctactctggaggctgcggcaggaggattgcttgatcccaggagtcagaggttgcagtgagctatgatcgcaccactgcacactacattttagcctgggcaacaacagagtaagatcctgtctctaaaaaaaaaaaaaaaagcaagcagtgatgtatgtttgcacgcacatacaaaagccatgaggagacctgcttagctagaaggaaggatttatgctggagcagcaggaaaggaaattggagggttgataagcaggttggtgggttgggatttgttttgtttgttttaggagacaaggtctcgctctattgcccaggctagagtacagtgggagggtcatagtttactgtaaccttgaaatcctggcctcaagtaatcttactacctcagcctcctaagtagctaggactacaggtatgcacccccatgccaggctaatttttttttttcaattttttgtgtagagacagggtcttgccatgttgcccaggctggtcttgaactcctaggctcaagctgtcctcctgcctcagcctcccaaagtgttgggattacagatatgaaccaccatgctggacctgtttttgtttttgaaggtgaacaattttaaaagtgtttttgggccaggcacaattcaatcacttgaacccaggaggcggaggttgcagtgagtcaagatcatgccactacactccagcctgggcgacacagcgagactctgtctcaaaataaataaataaaaagtgtttttgtgtttgagtggttaacataattaaaaatattttcaaaaagtacagaagggactaaaagggtcacctccactgcattagcttttggttttttttggttttttttttttttgagagatggagtttcgctctgtcgccaggctggagtgcagtggcgcgatcttggctccccgcaacctttgactccctggttcaagcgattctcctgcctcagcctcccaagtagctgagattacaggcacgcaccaccccacccagctaatttttgtatttttagtagagacagggtttcaccatgtttgcgaggaaggtctcaatctcctgacccggtgatccacccgcctcagcctcccctgctgggattacagatgtgagccaccgtgcccagtctgcattatcttttttatctatttatttatttcatttttatttatttacttacttacttacttattttgagatggagtcttgctctgtcacccaggctggagtgcagtggtgcaatcttggctcactgcaacctctgcctcccgggttcaagtgattctcctgtctcagcctcccaaggagctgagactacaggcatgcaccaccacgcctggctaattgttgtatttttagtagagacagggttttgccatgttggctaggctggtgttgaactcctgacctcaagttatacacccatctcagccttccaaagggctgcgattacagctgtgaggtgccacgcccagcctatgtatttatttatttttatttttgtagaggtgaggtctcactatgttgcccaaactgatattgaactcctaggctcaagtgatcctccctcctcggccttggaaagtgctaggattacaggcatgagccactgtgcctggcccactgcattattatatagaggcaatcagcgttaccttcctgagagatactgaggctgaacaaacatgtcttgtatatgcatttgcatctttttgttgttttaacacaagtggcagcatgctatttagacatagccttctgtacctgctgtacctggctcttctcacttaccaatatatcttggaaattatgccaccgtatgggcaatttgatttgactttcattgatttccttgtttttttttttgtttgtttgtttgtttttttgtttgttttttgcagttgttaactaaaaagttactccatgctggtgtctggagatacgttgttgaaaaatataaattgaatctctgctcttgtggagacaaatactaatctataatcacagaaataataatttccttaaagtggtagtagagctccaaaggaaaaacccagggtgccctgtggaggggtgatggtgacacttattctgattgtcaggaacagggtgggggtgctggttgacaccctaaaccaatgcaggctcttgctcagaaaaaactgtcagccctgagattttgcagatactttacaaagcacattcacctttattacctgacctggttctctgaataaccttgtcagaggcaaattttgctgttcccactaaattagttaatacatgtaaagtgcttacagcagtgccttgtagatggaaaatagtccacaaatattgtattgttttacagatggggagacagagccaggagaagtcaaacattaagagacaaatagtttagggccaggcgcagtggctcatgcctgtaatcccagcactttgggagaccagggcagacagatcacctgaggtcaggagttcgagaccagccaggccaacatggtgaaaccctttctctactaaaaataaaaaaattagccaggcatggtggtacgtgcctgtaatcccagctactcaggaggctgaggcaggagaatcactttaacccaggaagaggaggctgcagtgagctgagatggcaccactgcactccagcctgagcagcagagcgagactctgtctcaaaacaacagcataaataactgaaaattagacccagcctatttactgacagagctcttaattgttgtacttagccactgggctctaatagttttctaatgtcacttgtccatttttccctcaacaaacttgtggtaagaggctaagtgtttaccatgggccaggagtacaaagatgagctggagtacaaagatgaggaaattgtaggctccacccctgaggacaatagcggactgagatagcttaggaggcggtgaattcatgagcagcacaggtctttagcagaaacaagttgactgctggttgtgatgttataaaggacattcttggatcatttattgcaaactggctctgtgcagagctcactgtcttgggctttttgagtgatacgtgggtgtcttgggggactggagggttggtgggggaaatgtttttaggaggtaatttagtacatgtttctgcagccaaatacacatattactgggtggtcaggtgagatgatattaatacttatgtgaaaatgtagacataaagttccttgataagcaaagtaaagcaagtgaactaatttaaagaaaaccatttacagctggatgttgctcacgcctataatcccaacactttgggaggtcgaggcgggcggatcacttaaagtcgggagtttgagaccagcctgcccgacatggtgaaaccaactctactaaaaatacataaattagccaggcacggtgatgggcatctataatcccagctactcagggggctgaggcaggaggatcccttgaacccgagaggcggaggctgcagtgagctgagatcacgccactgcactccagcctgggtgacagagtgagactccatctcaaaaaaatttttgaaaataatggtgcagggccgggcgtggtggctcacgcctgtaatcccagcactttgggaggcccaggtgggtggatcatgaggtcaggagatcaagaccatcctggctaacacggagaaaccctgtctctactaaaaatacaaaaaatttatccaggcatgtagccggggcgcagtggctcacacctgtaatcccagcaatttgggaggccgaggcgggcggatcacttgaggtcaggagttcaagaccagcctggccaacatggcgaaacccc[135 bp omitted]cactccagcctaggcaacaagagcaaaactctgtctcaaaaaaaaaaaaaaaaaaattatccaggcctggtggcgggcgcctgtagtcccagctactcagaaggctgaggcaggagaatggcgtgaacccgggaggcggagcttgcagtgagccaagatcgtgccactgtactccagcctgggtgacagagtgagactccatttcaaaaaataaaaagaaaagaatagtgcaaatattatatgggtggctatggcagatgtaaaggtgattggcaattctttttctggaaaagctggcccaagggttaaaaggaagagctctggagtgaaagagactgcctttgcccttgaccttgggtaaaacttaacctcttcacatagtttcatcctttacaaaatgagaagggtgtggcaatgattaagaaaaattcagggctgggcgtggtggctcatgcttgtaatcccagcactttgagaggccgaggcgggcagatcacgaggtcaggagattgagaccatcctagctaacacggtgaaaccccatctctactaaaaatacaattagctgggcgtggtggcaggcgcctgtaatcccagctactccggagggtgaggcaggagaattgctggaacctgggaggcagaggttgcagtgagccgagatcacgccattgcacttcagcctggatgacagagtgagactctgtctcaaaaaaaaaaaaaaaagaaaaagaaaaaaaaaattcaggctagggggcatgcctgttatcccagcacttgggaggccaaagtgggaggattgcttgagcccaggagttcaagaccagcctggccaacatggtgaaaccgtctctactaaaaatacacaaattagtcgggtgtggtggtgggcacctataatcccagctactcagggggctgaggcaggaggatcatttgaacccggcagaggttgcagtgagctgagatctcaccactgcactccagtcttggtgacagagcgagactccatctcaaaaaataaaattgaaaataatagtgcaaatattatatgggtggctatggcagatgtaaaggtcattgggaattctttttctacaaaactggcctaacggttaaaaggaagagctctggagtaaaaaagacccccccttgcccttgaccttgggcaaaacttaacctcttgacacagtttcatcctttacaaaatgagaagggtgtggggatgattaaggaaattcaggctaggggcagtggctcatgcctgtaatcccagcacttgggagaccaaggtgggaggattgcttgagcccagaagttcaagaccggcctgggcaacatagcgagaccccatttctacaaaaaataaattaactggtcgtggtgacatgttcttgtggtcccagctactcaggaggctgaagccggaggatcacttgagcccaggagtttgaagctacagtgagccatgcttgcaccactgcactcctacctgagcaacagagaccctgtctcaaaaaaagagagaaagaagaaaaggaaaggaaaatgctcgtagcacctaaaacagtgctcagtaaatgtttgctgaagctgtaactatagtatgtagtagaaagtggtagttatttgaaagagagtcaaagatacgtgctctgggaattaccactaaatgaccaaaagttcacgtcaaaaaaataaaatcagatcaagttagaaatttttttttttttttttttttgagacagaatctcactcttgtcacccaggctggagtgcagtgacgctatctctgctcactgcaacctccgccttccgagttcaagcaattctcgtgcctcagcctcctgagtagctgggattacaggtgcccgtcaccacgcccagctaatttttgtagttttagtagagacagggtttcaccatgttgggcaggctggtctcgaactcctgacctcaagtgatccacccacctcagcctcccaaagttctgggattacaggtgtgagccaccgcacctggccagaaaaaattttattatgcacacaaaagaacagttggagattagtcagatgctccagtcactgtagtgagggcagtgttaataaagcctaaggaaggattttgaccttttttgtgattggctgttatacattaacaatctgtttacagccagtagagctgttcaaactgttttgtctatagttgattcctttaattttactgaattatgctgacaaggatgtaaagctttgtgttctgtttatgattgattagagctacatttcagggaatcaggatatcttaaattccggctatgtggctgtgggcagttggccttggagtatatctaaactgtggcctccactttcatttttcttgaaacattgctatcaactgggaagagtatgtgactttatgcccagtttcccctctcagatttttatgacggttgtttttctttttgttatgccatttgagggattgatgtttcttaaactatgaagtacttggctgtctctctccattgctgttcaggttaacagccaccatttgtaaacactttgttggagctcattccttctctgctaggaactttacaagaattgtctcaatcctaccacacctttggcaggacccttgttatcagagttttcattatccatgtatccatagttacaaggctatatagaaaagcaaaagtcatcacacaagaatcttgctaacaaactacttataaaattagtcactacttaaccatccctctgcttatccctgccagtcccattaacatgtttggtagtcaatttctggctgatgaagagatacattaagcatcaaggtaatgcaaatgtaaataaaactgactgtagactgaaatggcacatctcccaaaacttgtaggactaggcgaaatccctgcaagtgatgatagaaaaccttcagccttataccagttaacaaaggaagaagggaaatcaacaaagatgatgagatggtaaaaacttgaaaagtagaggatttgcctaggaaaaattaagcccttcggaaacttagtaaagctaaggaatattttggcaaaaccatcttttgtatgttgcaaaagtgagacaggaaatgaagtatagtgtttgggaattttttttttttgagatagagtcttgctctcctgtccaggccggagtgcagtggtgcgaccttggctcactgcagcctcagcctcctgagtagctgggattacaggcatgcgccaccacacccggctaatttttgtatttttagtagagacagggtttcaccatgttggccaggctggtcttgaactcctgacctcaggtgatccactcgcctcggtctcccaaagtgttgggattacaggcatgaaccactgcacctggcctagtgtttgggaaaactatactaggaaaagaatagttgctttaagtcattctttgattattctgagaattggcatatagctgccattataacctacttttgctaaatataataataataatcattatttttattttttgagacagggtcttgttttgtcaccccggctggagtgaagtggcgcaatctcggctcactgcaacctccacctccgggtgcaagcaattctcctgcctcagcctcttgagtagctaggattacaggcacaagccatcatgcccagctaatttttgtatttttagtagagacagggtttcaccatgttggtcaggctggtcttgaactcctgacctcaggtgatccacccgcctcggcctcccaaagtgctgggattacaggcgtcagccactgtgcccggccctgctaaatataatattaactttataattttagtctcattttccacccagatcttgtttatcactatctgggtggtagtgataaagttccacccagatcttgtttatcactattccctatgaaatgtttctgggtggccgggcgcagtggctcatgcctataatcctagcaatttgggaggccaagacaggtggattgcttgaggcccggagttcaaaaccagcctggccacatggtgaaaccctgtcactactaaaaatacaaaaaattagccaggcatgatggtgggcgcctgtaatcccagctactcgggaggctgaggcaggagaatcacttgaatctgggaggcaggggttgcagtgaggcgagatcatgccacggcactccagactgggcaataagagcaaaactccgtctcaaaagaaaaaaaaaagaaatgtgtctgggtatgtttttggctgcaattagctgaaaaccctgactcaaaatggcttattgcagatacttagaagcccagaggtgggcctccaaaggtcattgtctcagtggcctggactctgcatttttccactctgccatgttcaggtctcagctttgtccttaggaaggctccccatgtggcacaaatgcaggagtcacatccagaagaagaagcctttcttgccgggcgtggtggctcacacctgtaatcccagtgctttgggaggctgaggtgggtggatcacgaggtcaggagttcaagaccagcctggccaacatgatgaaacccccatctctactaaaactacaaaaattaaccaggcgtggtggcgggcacctgtaatcccagctactcgggaggctaagccaggagaatcgctggaacccaggaggcggaggttacagtgagtcgagatcttgccactgcactccagactgggcaacagggcaaaactccgtctcaagaaaaaaaaaaaaaaaaagaaaaggccaagcgtggtggctgtaatcctagcactttgggaggctaaggcaggcagatcacgaggtcaggagtttgagaccagcctgaccaacatggtaaaaccctgtctctactaaaaatacaaaaattagccgggcacggtagcatgcctgtagtcccagctactcgggaggctgaggcaggagaatcgcttgaacccgggaggcggaggttgcagtgagccaagaccgtgccagtgcattccaacctgggtgacagagggagactccgtctcaaaaaaaaaaaagccttccttggtttcctgccaatttcctgtcatgtttctttgtcccgaattgggccaatatccatgcccattcctaatacaattaccttaattgacttagattagccctgaagcatgtagtgatgtgggggaggaatgacaactgaagaaaatagaaaagaagggacaaaggttgttgagttggcaaccaacaattcctgttatagctttttaaattaattcactttaagtggtactgattattcatattgttatttccatgtatagagagagaagaaattggaggcttagaggaagtgaagtgacttgtccaaggtcacatagctaagtggaatttattttttttttttttacttttctgagacaaagtctcactctgtcgcccaggctggagtgcagtggcgtgatcttgactcactgcaacctctgcctcctgggttcaagtgattcttctgcctcagccacccgagtagctgagattacaggtgtgcaccagcatgcccggctaattttttgtatttttagtagagatggagtttctccatgttggccaggctggtcatgaactcttggcctcaagtgatccacctaccttggcctcccaaaatgctaggattacaggtgtgagccacggcgcccagctactggaagtcatgatgcaagctgttgtttgaatcatgaattccaaacttaatgagtgctaggttgaagttattttttttctgtttcccttaatcttctattgagatataacatgtattgaagcacagacatcttttgcaagaattcattgagcactatagttatattcatctgtacttactgtctccctggtaaaggcataaactcccttcaagatggggacatggttttatactttcctgaatctcctttagtgcttatatctaacagcacttaaccaggatctggagggggtcaaccagtcttgcttccttccaatctactctgtagatgtttgtgtttttctactgtaactatagaggtaaaggagccaatggtgtttccagtgtctggcacataataggtgctctatgaatgtcaaatgaatgactgaggcataaaaagttcttcctatgacataagtagtataataggaagatcactgggatagaattttcttagaagacgtggctcctagtcctagcactattactcttactgactataactttggacaagtcatttgtttaatttcaaacatttactgaattctgtgtaccaaatactgtacaagttgttcaaaaggctacagagtctctactctcaaagtctagtcaggggagagattacacaggagtgaaaccccatctctactaaaaaaaaaaaaaagaaagaaaaaaatagccaggcatggtggcaggcacctgtaatcccagctcttgggaggctgaggcagaagaattgcttgaacccaggaggcagaggttgcagtgagtcaagatcacactactgcactccagcctgggcaacagaacgaatatctgtctcaaagaaaaaaaaaaaaagaaaaaaaaagtatgtttagagatccttaaggaagttttgaacctatccaatatgttgggagtcaagatgaggagggtaaaagtaggaattcagagaaaggataaatattttgaaggaaggcagcataatggttaactagtcagactgcagacaaacaagcagtacaaatcccatgttcccaggtcttagctggaggattaaatcccagattctcatccttgagaacctctttaagcttgttttcccatctgtaaaatgtagatgataatagaatccttttcctactgtaaaatgatgcacattgggggcttcatgtagccagatatataataaatcctcaatacatgtagcagtggtaggggagaactaaaagacttgttaacatattggatgtaggtgagaaagaagaatcaaaaagaatatccaggttcccgccctgggaggggcagacataaatggagccaggaatggtacaaggagctttgtggtgggcactcactagtacctttctttggaatagctcaacaaatgttcactaagtacacataaagtcaatataacttgatgagctagagttaggctaagatgttgagttagcagaagagtagtacccaactaagggcttgaggaaggcttcctagaaaagataatgggtgcacgtagtcctgaaggatgagcaaggcttgcgaggagggaaggtaggaagggcattccagacaaagggacaaacatgcacaaaggtgagacagagcatggtgaacacacaaagttgtaggcattttgtctttctaggacacaaaaaacaaggtgatgaaaacaaggctggagagacaagcggagaccacaagtggtcacccctcactggcctcgctgtactactggactgctccagcccttcctggcccagagctagagatggcaccacccccgcactgtgcacacaataggtacagacactctcagccccaaacccctccagcctgttactgtgagactcacacatcctgttttcccaagcttgccccacagggtgagcaaactggaccagctggattagagtatttggaaaagtgcaggtggagtttctaggctatgccacgtcaggccagggggtgagatttttttcccttcccctggtctttgggctggggcactccctgaggagggaggggtgtgacccatcccacccattggtggtccatgatccattcatccagtacatcatccataagcatctgctgagccgggcgcagttgctcacgcctgtaatcccagcactttgggaggccgaggtgggcggatcatctgaggtcaggagttcaagaccagcctggccaacatggtgaaaccccgtctctactaaaaatacaaaatttgccgggcatggtggcgcatgcctgtaatcccagctactcgggaggctgacacaggagaatcgcttgaactcaggaggcagaggttgcagtgagtcgagatcgagccatcgcactccagcctgggcaacaagagtgaaacgccatctcaaaaaaaaaagcatctgctgaaggcacagtattgtgttagaggcttggactaccctgaggaataatagtcctgacacttgaggacatccccatccaattggaaaggcactggataaacatctaagaaaatgtcacaaggcataaaagctgtaataataatagctaacttgtatttagggtaaacaaaaggctgaatcaggctttggactaaatattttgcctgtggctcatttaatcttaataacaaccataagattatctcattttatgatgaggaaactgtatacagagaggtgattgacttgcctaaggttgaacagcttatgagtagtagagccagtattcaaatccagtcagcctccagtgtcccctctctttagtcattagatatagtgctacccagagaatctgctaagccttatagataaatgctatgaattcagaggcaggagcaattactgtggcttgggggcatccacaaagactttctaaggtggtgacacctgatttgggccttgaaactggttgaatagagataagaaaagaacagataatcaatttaactgccgttgtgttttgaatcatcactttaagcctagaatgacaaagctggaaaagaccctaaatatcatctagcccagtggttatcaaattttcttaggatgtggacatttttctttaaatgaaacatgagtagaagccagatgcagtggctcatgcctgtaatcccaactacttgggaggctaaggtgagaggattgctcaagcccagaagttggacaccaacctgggcaacggtgagaccttgtctcaaaaaagaaagaaagaggccgagggcggtggctcacgcctgtaatctcagcactttgggaggctgacgcgggtggatcacttgaggtcaggggttcgagaccagcctggccgacatggtgaaaccctgactctactgaaaatacaaaaattagtcaggtgcagtgctgcatgcctgtcatcccagctactcgagaggctgaggcaggagaatcgcttgaaccccagaggtggaggttgcagtgagctgagattacaccactacactccagcctgggtgacagagtgagactttaatttcaaaaagaaagatgagcagtaatcttgtctcttaaaaaggaggaccaaacattccctagccccaaaacattccctgaaaagttcagttgagaaccactgatctagtccaatgtcctgggatcctcgcttttatctttgctatctggagaaggaagagacagcggtagttcccaaaagacacaaacaatggggacattttaaacgggagtaaccagctaagcactctgctgctgctgcttgtctatttgccctcttgtcctgcctcagggtgaattgttggcagctacaaatggcaaccaagagagaatggagttggggcttagaagtgcggtagaggaatatgaagggggctggagttggagaggctcttaaagaaagagctgactatattgggactggagagttaatgtaaatctcttcttggttcatggggattttgttgttattgtttttttccccatgacacaactctcaggagatcctgagaacacgtgccctgatttggggggggttttaattttaactttttttttttttttttttttttgacagagtctcactctgtcacccaggctggagtgcggt[133 bp omitted]gacggggtttcactatgttagccagaatggtctcgatctcctgatctcgtgattcacccgcctcggcctcccaaagtggtgggattacaggcgtgagccactgtacctggccaaaatttttttttaattagagacagtctcttgctgtgttgcccaggctgatctcaagcagtcctcccaccttggcctcccaaagtgctgggattacaggcgtaagctatagcacccagccttccttctttccttaattctatttttttttttgtttgtttgtttatttgtttgcttttgagatggggtcttgcactgttgcctgggctggagtacaatagcgtgatctcggctccctgcaacctctgcctcccaggttcaagggattctcctgcctcagcctcccgagtagctgggattacaggtgcctgccaccatgcctggctaattttttgtatttttaacagagacagggtttcactatgttggccaggctagtctcaaactcctgaccttgtgatctgccctccttggcctcccaaagtgcggggattacaggcatgagccaccatgcccagccttccttaattctattaatatatgaatccttttcttttttttaaaaaaaagagatagactcttgatctgttgcttaggctggagtgcagtggcacaaatcagagctaactgcagcctcaaactcctgagttcaagcaatcctccagcctcagcctcccgagtagttgggaccacagttgggaaccactacacttggccctactacgggtttttcctgtttgtttgttttttgtttttttgtttttttgtttttttgttttgagacggaagtttgctctcgttgcccaggctggagtgcaatggcgcgatctcagctcactgcagcctccgcctcccgggttcaagcgattctcctgcctcagcctcccgagtagctgggactacaggcatgcactaccatgcccggctaattttgtatttttagtagagtcggggtttctccatgttggtagtcaggctggtcttcaactcctgacctctggtgatccgcccatctcggtctcccaaagtgctgggattacaggtgtgagccaccgcgcccagctgtttgtttttttgagatagggtctcactctgttgcccaggctggagtgcagtggcatgaacatggcttactgcagccttaacttcccaggctcaagcgatcctcccttctctgcctcctgaatagctgggaccacaggaatacaccaccacacctggctgatttttaaattttttgtagagccagggtctctccatgttgcccaggctggtctcagactcctgggctcaagtgatcctcccacctcagcctcccaaagtgctggggttataggcatgagccactgtacccagcccccttcagggtcttatctttataaggggtggggggtggtcagcacctttctcattgttacctctaccttccctaggtatgtgcaggtgaaatttgtctgcattcggacccaatcaaacaggaagagaacgcgggaggcagacatgtgcccagcgtacttgctcctaaggtacaacgagagactagatagactatttatcagtgaactaaacacacagcacatacatggtgactctaaagtggctagtcctggaggagacaccactggcaaatctcaaaagacaatgtgcctgcagagactccagcctgtgcagcccacaaccaaaaaagaccttgacactgccgagaagtccctggttgagccatcgttttgcctagataaggtacaagtgtcctcaaagccagagcaggaaggcatcactccttctgacctggccaagatagcaaaagtgatgaagaactttcttaaggtagatgagggttccatggcttccttcagtgtgggtgacagccagcacctggaccggctcagcttccagagcagtaagatgaccgacctgttcatccgcttcccagagaatctcttgctacaccgggtggagaacacccagggccacatcctctatgctttcttggtggagaacaaggaacgagaaagtcgagtggtgcactttgctgtgctcaaggcggagacagtcacctctgtggccaagatgctgagcatcttcacagagttcaactccgattggcccaaggtcaaggtggtctttgtggacccttcattccattaccgggctatcctgcaggagatctttcctgctgcccgcatcctcctttccatctaccacacaacccgactcttggagaagaagttgcatcgtagttcagcaaatccatcctttaaaaggctcatgaaggaagccctgcgggaggccgtgtttgtcacttctgaagccagcctgaaaaatctctgccagatgtcccaggccgtactggatgaggatctcttcaacttcctgcaggcccactggttcacctgtgaactgctgtggtacatgcatgttaggaagggcctgcttgcgtgtaacacctacatggacagcctagacattgtcaccagcaaggtgtcaagcctctttcgggaacagcagtcgctgctggactgcatcctctgctttgtggattacatagacttctttaataccaaaggcttgaagaacttgcccacacctcctcccaaattaaagagagctcggccggcaagcatgccactgaagtccaagaaggcttttggaatctgtggagagagccttaccagcctccctgcagaagagaccaagccagacgcacagcaggtacaggtacagcagcagtcacaagtgccgccctcgcaggttggcatgctggacaccttgcaccagagtggctctgaactagcctacaagctgtgccacaatgagtgggaggtggtacagaactccacccacctggtggacatggctggctcttcagtggacgttcagctgctagaggactctcaccaggttagcaaagatggctgtagctgcagctgttcctttcaacaatggtaccacctgccatgccgacacattttggctctgctgcacaccagccagcagccggttggtgaagccatggtgtgccgccggtggcagaagaagtaccagtacctccttgggcccaatggggagctccaggatcgtggtatggtcccaaacacaggccagcctgagaagcaaggacggaacgacatgattcaggacctaagcagggagttagcaaacctgctcatgcagaccgaggggccagagctggaggaacgctactccaccctgcgcaagattgtggatatctgggctggcccctcccagccatctgagctctttcagcagccaggagactttaaggacgtgggccgcctccctttcctctggggaaagcaagaagaaggggagggattccctcctgctacagctgtgatgcattattgaagcactttagctgaagcattggaccacaaacacttctccttggaagtgtgagagtttaaagtgggcaggacatactagggtttagcattttagccaatgtcttcctaggtggggctaggaatattgttacagtagagaggaagggaactccactgtgtgacagtcctttcaatctgccccttttcagccctacttttggcattccttgggagcctcagttgttgttcaaggccaaagttatctccgtgctgcaaggtcaccctcttcctcccccagcccctgagatcagatcttatttgctctgcaaagatgaatccctgcctcaggttagggtgagacaaaatcggtctggtaaaagggcctgttttcagggacaaagggaatgaggatgatctttggctgttgctgctctttatgaagaatcttatttgtaactttttattcatattaaagttgtttttaataaaattaaacaagggaaatgtgttctgcttgatcagggaaggaagaggaattgcatagcaataggactcgactttacagttaggaagtggctgctctaggtggatttattaattttaaagaaaattgaggccaggcgcagtggctcacactcataatcccagcactttgggatgtcgaggcgggtggatggatcatctgaggtcaggagttcgagaccagcctggccaacatggcgaaaccctgttctactaaaaatacaaacattagccaggcgtggtggcgcacctgtaatcccagcttcttgggaggctgaggcaggagaatcgcttgaacccaggaggcggaggttgcagtgagcctagatcgtgccaccgcactccagcctgggtgacagagtgagactctatctcaagcaaaaaacaacaacaaaaaaaaaagaaaagaaaattaagtattagcaacctaatggggttgtggagccaaatagaacctgatgcctcacattcaaggatttggcaatctgcgtcttaatttgcctccttcctacaactaagccttcaaggttgatttcaggtttccttatattctagcgggaagaggccaaatagactggagggtgtgggggaaaaacctgaatcttagacttgactgccagcaacttgctggggaactgtgggcaatttctttgacctcagtttcctctgtaaaaattagcatgttggcctgttctaatcccagatttcccctctaggtttacataagcacctttttgttttttgttttgagatggagtttcgctcttgttgcttgttgcccaggctagagtgcaatggcagaatctcggctcactgcaacctctgcctactgggttcaagcgattctgcctcagcctcttgagtagctgggattataagcatgtgccaccacgcctgcctaattttttgtatttagagatggggtttcaccatgttggtcgggctggtcttgaactcccgatctcaggcaatccacctgcctcagcctctcaaagtgctgggattaaagggatgacctactgcacccagcccaataacattttcgatgcgtaagtaccaacactgatttgatgttgctagttggtaatcttaatcctccaaggcctggtaaacacccagttttctaagtctgccatcttcaagggaactgaggacaagagaccagttagtaggcccttgcactactgtagtaggaccctaaataagtcatggcatcattctgtagaatactggagggggttgggctagagaatgccaagttttggcttgtttaaggggatctggatttcctcagctctaaaagttgggctcctgatccccgaaggaggagtagaatttgagacctggaactcagtttccccataaggtagaatatgcgttatgactatatatgcactgtttcctaaattccaggggctttagagtttcacacacacacacacaacaaaacaaaacccgcggtggctcacgcctgtaatcccagcactttgggaggctgaggtgggcgaatcacgaggccaggagttcgagaccagcctggccaacagggtgaaaccccgtctctactaaaaatacaaaaaattaactgggcgtggtggcgggtgcctgtaatcccagctactcaggaggctgaggcaggagaatcatcgcttgaacctgggaggcggaggttgctgtgagtcgagatcttgccactgcactccatcccaggcgacagtgcgagactccatctcaaaaaaagaaaaagaaaaaatatatatataactgctatttattttccttttcattttctgcttttgagggagtttccatagtaacgtgtccttccagtcgcctagcctgaagggaagccccggagctccagcttcaaggctcagctctcccagatgcaagtatctttacctccagccagctccttgtaaccctggcaacacggcccgcccgcgaatcgtcacgctacgattggtccgtggtgctaaagcctgaaagcgaattcctcagacattggtccgagtcactgcgatgctgacgctgtggttggtgagtttggatgtcagtcagagtcggaggcagggtcaaatagggagaaatggcgacggagcctggctgtgggtgagtgcttcctgaaggggtgaaagtgtgagacagcggatcaccgcagttagccgtcacacagctcccaaagggatgggagggaggttttcttctcatccggctccagctggactctgggaatgtcagacatccacatctcccacccaggttagaggtgagaggtcaaaggccgtattccctctgttggtttttggaccccaggtactgtggacagcagtcaggatcccgaaccaaagactcaactttcagctacttacagagtaatggtgggcaagtcacttagcttctttgagccttagtttatcatctgtaaaatgaggacagtaactcggtctggggccaaatagaggaaacaatggaatagagtattgctgctaaaagagggatatagtagaggcaggagaagctatgcacatttgttagccatattttatggtggaagggattgaggctcagagagggtcattgacttgcccaagataacacagcaagtttggagcaattgcagttctcttatacataccaggaccaaaggaaagaatggatgccaatcagtcatttataaatataaaatcgtatttttattttattttattttttgagacagagtttcactctgtcacccagagctggagtgcagtggcgcaatctcggctcactgcaacctcagcctcctgggttcaagcaggtctcctgcctcagcctcccgagtagctgagactacaggcatgggccaccatacccggctaattctttttgtatttttagtagagacgggttttcaccatgttggccaggctggtctcgaactcccaacctcaagttatctgcccaccttggcctcccaaagtactgggattacaggtgtgagccactgcacctggctagaatgctatttttttaaaaggccatatgcagctctggccatacctatttaaatcccctggaaccatatctttccatagctaacttcttatcatttagatttcagctccaatgtcatccttctcccctgagaggccttccattaccactttaactaaagtatccctcccttccccagcttactctctgacatgttactcaggtttatggtctttgtaagcttcattattggatatatatttgcttatttgtttacatgtttattgtgtatcttcccctagaacagtgctgacatatagtaagtgttcaacaaatattgtgtggatgaataattgaagagccaggtccctgctgtctccttaaacctctgttactctccataggcccatctttggaaaaaagatctgggaatgattgtctagcctccagcctcaacttacttgatgcttgagagactcaaagccccgtggtcagctgccctgcaaagaaagtattttgaccttggcatttggacagctcccatctctcccatggccctgacaatgctgaatgggctcctgattaaggactcaagcccacctatgctgctgcaccaggttaacaagactgcccagttagataccttcaactaccagagctgctttatgcaaagtgtctttgaccatttccctgagatcttatttatccaccggacctataacccaaggggtaaggtcttatataccttcctggtggatggacctcgggtgcagctggagggtcatcttgcccgagcagtctactttgccatccctgccaaggaggacactgaaggcctggcccagatgttccaagtattcaagaagtttaatccagcatgggagagagtctgtaccatcctggtggatcctcatttccttccactgcctatcctagctatggagttccccacagctgaggtccttctctcagccttccacatttgtaagttcctccaggccaagttctatcagctgtcccttgaacggcccgtggaaaggctgctcctgacctccctgcagagcacaatgtgctcagccacagcaggcaacctgagaaagttgtatacactcctgagcaactgcatccctccagccaagctgcccgagcttcactcacactggctgctcaacgaccgcatctggctggctcaccgctggagaagccgagctgagagcagccactacttccagagcctcgaggtcaccacccacatcctcagccagttctttggtaccaccccatctgagaaacaaggtatggcttctctgttccgttacatgcagcagaactctgcagacaaggcaaacttcaaccagggcctgtgtgcccagaacaatcatgctccctcagacaccatccccgaaagccccaaactggagcagctggtagaatcccacatccagcactccctcaatgccatctgcacagggccagcagcccaactgtgcctgggcgagcttgctgtggtccagaaatccacacacctcattggctctggctcagaaaagatgaacatacagatcctggaagatacccataaggtgcagccccagccccctgccagctgcagctgctactttaaccaggccttccacctgccctgccgccacatcctagccatgctcagtgcccgccgccaggtgctccagcccgacatgctgccggctcagtggacggcaggctgtgctaccagtctagacagcatcctgggcagcaagtggagtgagaccctggataagcacctggcagtgactcacctcaccgaggaggtgggtcagctgttgcagcactgcaccaaggaggagtttgagcggaggtatagcaccctgcgggaactggccgacagctggattgggccttatgagcaggtccaactctgattattctcgatgcccagagatgctcatgcacctgtgcacactcacatccacccatacacacacacacacacacacacacacacacacacacactcccttacactgttgtacttccgtgggccctccttccagaacaaggacaacaaggacaaggttgaagggtcttctcatctaccatggcctgctacctagcatgtgtctagctcaatgagacaggagtcagcaaatcttaatctgtttagtttactcaggtggccacatacagtctctgttgtatattcttggttttgttttaatattttttttctttttttttttttttttttttttgagaaggagtctgtctccgtcacccaggctggagtgcagtggcgcaatctctgctcactgcaagctccacctcctgggttcacaccattctcctgcctcagcctcccgagtatctgggactacaggcgcccgccacaatgccgggctaattttttgtatttttagtagagacggggtttcaccgtgttagccaggatggtctcgatctcctgacttcgtgatctgcccgcctcggcctcccaaagtgctgggattacaggcgtgagccatcgcacccggcctgttttaacattttcataaggtaaaaacctttcttagctcaaaggtctttaaaaaagcaggcaatccagctgggcatggtggctcacgcctgtaatcccagcattttgggaggctgaggtggacagatgacttgaggtcaggagttcaagaccagcctggccaacatagtgaaaccctgtctctactaaaaatacacaaattagccaggtgtggtggcgggggccctgtaatcccagctactcgggaggctgaggcaggagaatcgcttgaacctgggaggcagaggttgcagtaggccaagatcctgctgccactgcactccagcctgggagggtgagactccatctaaaaaaaataaaataaatggcaacccctggtctaagataagagataaaacatcaggtggtgaggttgaggtttggggcttggtagcagttgccccagtcatgagatgactcacttaacccgtctcctttaagtgagctgggctgggaggcttcctacaggggaagaggcccctctggggagctgactcagccaggctccctgaacttttttccttgtcccatcctggggtcaataaaactgaatgttgcatattctagcacttgtctagttttttttttgttccatagaaggcagtttagggtatatcatggagagaatagactttagagtgttatacaacatgtgaatcctggttggttccttccctgcttgatttttgtgcctggttctgccttttactagctatgagacttattaggataagttacccctctaaacctcaacctgattatctgtaaaaatggggatctccacagggtatgttcacagagcaggcatacctagtgggtgctcaattaagtattaattttccttccttgcctatggtcctatgacctgccttcaacatgctgggaaatttaaggcaagaggagaattcaaatacctaggacttaatataagaaattctggccaggcatggtggctcacacctgtaatcccagcactttgggaggccgaggcaggcggatcacctgaggtcgggagtttgagaccagcctgaccaacatggtgaaaccgtgtctctactaaaaatacaaaaattagccgggcgtagtggcaggcacctgtaatcccagctattcgggaagctgaggcaggagaatcacttgaacctgggagacggaggttgcagtgagccaagatcatgccattgcactccagcctaggtgacagagcaagactctgtctaaaagataaaaattaaaaaaaaaaaattctgggtaggccaggtacggcgtctcacgcctctaatcccaacaccttgggaggccaaaacaggcagattggagcagcctgggcaacatggcaaaaccccttctgtacaaaaaatacaaaaattagctggatgtagcacgtgcctgtagtcccagctactcaggaaggctgaggtaggaagatcacttgagcccaggaggttgaggctgcagtgagctgtgattgtgccactgcactccagcattggtgacacagtgagaccctatctcaaaaaaaaaaaaaattctgatcaagtcttcaaaacaacataaaagcagccttaactctccaagcaggggcccctacctcagataatttccattgtatctacctgacaaaacctatctcctgtcttagtggtatctggagaaactttagggtctggaagtccctgatgaaggactggaatttgtcagaatggctcaaccaccagctctatccccatccctgccataggccctcctcccaaccctgtctgcccaagaaccatacggagaaaccaccctacatatctggtgctatttcatccatctacaagcaggagccaggaggctggccccttttagatctcactaggggcatcttcccagaggctgtgtgggcatgtgcctgctcccaccgcgccccctccacagcaccctctggctccggatgggccatcatgaaagcttgagcggcccagatcaggtcctcttcccgaactcctgggacgggcacggtggggatgccagcgatcatcatggcgagggtgaggatgcagatatcaggctgggagctggcctccttccccactgcctcagagggtaccggtagaacccgtggtgacagcccacacagcatcaggggcctaggcctgctggggccacccaggtcaggggctctgcttctggagtagccattgtcccagcccaagctctccagctgcctcacatgcgggaatttgtggcagtttcggctgtattccttccgtagtgtctcccagctagtccccccagggcagcccctggcttgtggcattgccagggctgggccccaggcctgggcagcaggtgccacctgctcagctttctggctcagtgggcctgttccaccagaggccaccaccactggctctacaggactacagaggccaagggacaagcctggagaagcagccccacctgcagagacaggaatgaaatggaacgttattctcagttctttgaggagggggccctgaggggcagggcatgggagcagagcttgggggcgtaactaagaccagccccagcggactgtctagaggttgggaactaggtgttactcatatccacactcccagtccccaacacggagtaggtgatggagaagcgtttgttgaattaatgaatagtgagcaagcgggtagttattgattggcaaggatgtttggaatggcttttcttctaaaagaattgattctagggccagcccccaaatgcccagcagaaccgccacctccccagagccagaaagcaacttctcaggggaagctgccgcactccctccaattgcaggtgccccccgctcaccttggccggaaggcagaggacctggatgagtttgtggagtcctgaagtaggacatggcttccccaaagccccggtttgtgagggaatagtgatctgccgcctgtcctcccttcttcacccttctagaatgtcacctcatagaccctccccttcacacttggaatccactttacagcgttgacctattcattctagaacctggacatgacaataggatgaggttaaaagagcaccagaccaggagctgggtgttctaggttcttgccctaaccttgaacgagtcacccagatagttttgttccttgatatccttatctgtaaagtgtgtctgatgactgcccactacctcattaggagttttgaggatgaaatgagatcatttgtatggaagcagatgaccagagatggaaacacaggagccaagtgcttcgtgccttgtagagtaagacttcgggtcagacccagtattggtatttttctttttctttttttgagacagagtctcactttgtcgccatgactggaaggctggagtgcaggagcaagacctcagctcactgcaacctctgcctcctgggttcatgcaattctcctgcctcagcctcccgagtagctgggactacaggaacctgccaccacacctggctaacttttgtatttttagtagagacagggtttcaccatgttggccaggctggtctcaaactcctgacctcaagtgatctgcccacctcggcctcccaaagtgctgggattacaggccaggtattggtatttttcaaaattcctcaagtgattataatatatgacaaagttggaaccttttttctagggacatacttctcaaccctggctgtacatgagaatctcttgagaagcttttacaaaacacaatgtctaggcctaatttcccaacaaatcaaatacgaatccctagggatgggatgtgggacaccagcactctttacatatcctaagatgactctaacaagcagccagcctagggacccctgctcttttgctccgacctgctgacctgcagtgattctaaacgaagtgactctcataggctgtaggggcaaggagaccttccagtgatcaagatgtcagcatcggctgtttatttctggtcttggctggcagcaatgtggccaacttcggaccagccagccacaggtctggggctccaggatgcagctgtgctctggtgcactgtgggtcttcactcatacttgcagaaatccttaagttctttgggcaggtggagcccatcaatggccagccggtgcaccatgctcctttgtatcactaggcggcacagagtctgcagggatggcactgtgggaagaagactgtgaaaggcaaactgaactggagggtgggtctgaggccaagatccagaaggtctaggtcatggtccccactttgtcattaaatgtgggcaagtccttactgctctctgggcccagcctgcttcatggggctgagagaagcacctcttcctgagagctgccacaaagctgcagccctgtttatatcataacacttagcacaatcccttccccattcacttagcagcttctgggggcaggggtagtgtctgatttgcctgtgcaactgaagcctccagcacaggcctggcacaaagagggttctggtgcattgagttcatgaaatgtgatgagaggtataactgcaatgcttaccagggctataatgaatcatactcagcattaagaagctctcagtctggggtttgttatgcctcgaagccaatagccaatatgcccaagtctatgagcatgtttctttcttttctttctttttttttttttatttaaagagagagggtcttgctctgtcacccaggctgaagtgcagtgctcagtgaactgcagccttcaattcttgggctcaagcgatcctcctgccttagcctcccaaatagctgggactacaggcatgcaccaccatgcccagataattatttaattttttgtacagatggggtctcactttgttgcccaggcttgagctagctagcttgcttgcttgcttgctttctctctcttcctctctctctctctttcttttttttttcagagtcttgctctgttgcctaggctggagtgcactggtgagatctcggctcattgcaacctccacctctcgggttcaagtgactctcctgcctcagccttctgaatagctgggattattggcacatgccaccacacccagctactttttgtatttttagtagagacaggctttcaccatgttggccaggctggtctcgaactcctggcctcaagtgatctgcctgcctccccctcccaaagtgctgggattacaggtgtgagccactgtgcccggccaagcatgtttctaagaaaagggcaaacaattctcaaagaggcccctaatatctaaaattggtttagaatccctgccctaggtgaatacaggaaacactatcaaaactaaaagggaacttgtagggcatcttaatcaatcaaccaagataggtaccaaggcccaaaaccatgtagaggcttgtgcaagatcacaagcagaggtgcaatttgaagctagattctcccactcttaaactagtgccggacagacgaaggcctagcacatgggctacggagccctagtagattccagtccccacactgagccaggaggggtcgctgcccagggatacctacagccatactcgagctggacaaggcgcacgctctttgtggaagcaaacacgtccaccaccgcgtagaggggctgcgcagctggcagtccccgggcgctcgggcccatgtcctcgccgttgatgatgatgtgcatgtcggccgtgccatcggggcgcgggcaaaagaggacacccaggcggctacggcgcgcggtcggaggcagcacgttcagctcatagagctggtccaagagatggctgtagagccctggccggctgcggcccaccaggcggtcccggggaatgcgaaactgctcaatgcgcagatatggttccacgaggagggttggaggtcggctgggggccgctgcctccgcctccgggcggccctcccggggcacgcggttgtggtggcgcgtgatggcgaagacccaggtgtggcccaggttgaccagatcgggcagagaaaactcgggaacgggggccagactggcggggtccagcgcggtcagaccgagacgcagatgtccgcaccagcccagctctttctcctcgatctcgaccaggaagacctggcccggggccagcggctcgcggctgaagcacacgccgtgggcgaagctctccacgcgtgtggcccgcgtcccagaggggtccacgcggatgttggcaccgtgcacccgatggaagcgggtgggagggggctccgggcgctcgagtccccagagtgcacccgaatccacgggctcggaggcagcagccatctctcggccatagggcaggccagctggcgccgggggctattttgggcggcgggcaatgatggtgaccgcaaggcgaccttgtaaggcatttcccccctgactcccttccccgagcctctgcccgggggtcctagcgccgctttctcagccatcccgcctacaacttagccgtccacaacaggatcatctgatcgcgtgcgcccgggctacgatctgcgaggcccgcggaccttgacccggcattgaccgccaccgccccccaggtccgtagggaccaaagaaggggcgggaggaagactgtcacgtggcgccggagttcacgtgactcgtacacatgacttccagtccccgggcgcctcctggagagcaaggacgcgggggagcagaggtgagctggcaccggaggctggaggggatccccgagcccgggatcggtgcgcggcagaggaggctcgcgggtgggagctggcgctggggccggggcttccctcgcggaggcgccgccagcaactccccgggggctgctgcacggaagcgctgaggagcgagtcaacagcccctctgctgcctcccgtagatgatccgagccgcgccgccgccgctgttcctgctgctgctgctgctgctgctgctagtgtcctgggcgtcccgaggcgaggcagcccccgaccaggacgagatccagcgcctccccgggctggccaagcagccgtctttccgccagtactccggctacctcaaaggctccggctccaagcacctccactactggtctgccgccctgccttctgggcgggattgggagaagagatgacggatgagggatggggggtagttctgcagacccctgaggatgcctgggagccgggagggctggaaagggcccctccaactgcgccaaccctgccctgacccccctcccaggtttgtggagtcccagaaggatcccgagaacagccctgtggtgctttggctcaatgggggtcccggctgcagctcactagatgggctcctcacagagcatggccccttcctggtgagtggacagcagggggaaagcacagttcccaaagtaaaaggctggggaaagcgagagaggggctttgtgattttccaaaaagtttccttccttctaagcctcgggattttcctctatgccattggctttgctgcctgtacctctcagaggttttacccacatgtaaagtgcctctcatggtggccctttccctccacccagctggcccttgggacttactcagccatctctttcctcctcaggtccagccagatggtgtcaccctggagtacaacccctattcttggaatctggtatagctggagctgtgggtgtgtctgggcacttggatggggtggcatttagctaatttttccctcccctctagattgccaatgtgttatacctggagtccccagctggggtgggcttctcctactccgatgacaagttttatgcaactaatgacactgaggtgagtctggtgcctgcccatctgccccaggctccccggtcctccatccatggcatgatgctgggagagagagcatggccttggagtctacttttcgctctgtcatatgctattgtggtatggtggccagtcacttcctcttgcacaaatagggtgggttaatgtcattatctctgaagttctttccagttcaaataccaaagcttcctgattccctctgtcttgctctgccatccccaggtcgcccagagcaattttgaggcccttcaagatttcttccgcctctttccggagtacaagaacaacaaacttttcctgaccggggagagctatgctggcatctacatccccaccctggccgtgctggtcatgcaggatcccagcatgaaccttcaggtgcagggtagctgcaggagggaagggaggtagcttgaggctgtggccttacagttagcaaggtcagactgactggtcaatgtccccatccaacccagcttcctgcataacctccccaccaccggctgccctaggtctgtctgtgtgcctcccacacaggaaactcacctgtcaggctgccagctctgtgttttgcattgagtggcctctcatacccaccggcctacataaaccaccctgggtttcagcttccggattgctgaaggtctgggtggtagggtgagggaggctcttcctttttgccctccacatgagctgagcaccctgggtgtttcacaggggctggctgtgggcaatggactctcctcctatgagcagaatgacaactccctggtctactttgcctactaccatggccttctggggaacaggtatgggatagggcagttgggcaatctctggggtgaggcaggtcacatgatctcaggtctgtcctccaggcacatgatatgacaggcccagcccaggtttatgagcagcaggtgggttgcagaaagaacctagtgctgaaaggccaaagaatagagatcagtttttctttctttcttttttttttttttgagacagattcttactttgtcacccaggctggagtgcagtggcacgatcttagctcactgcaacctccacctcccaggttcaagcaattctcatgcctcagactcccaggcagctgggactacaggcgcgtaccaccacacctgcctaattttttgtatttttagtagagatggggttttgctgtgttggccaggctggacttgaactcctggcctcaaatgatcttcccaaagtgctgggattacaggcatgagctacagcgcccagccagaaatcagattttaaaggaactaaggaggcctgtctgtatgaccctggggcacctctttgggagctagcttagatgacatacagaccacaccctgtgatatctttcccagtctcctagggtcagggaggttggtgggaggtggggggtatgctcgcctcctctgccttcctcttcccaccagcagctgatgcgcttttcactctcatctcctacaggctttggtcttctctccagacccactgctgctctcaaaacaagtgtaacttctatgacaacaaagacctggaatgcgtgaccaatgtgaggttctgccatcactttgcatgagctctcccatccctaatcctgagaacaggaccacattccctccttggggactccttgttctccgtccctcattgctttcttgcacctttaagcaatttagtgttctctgggacatgtgtctaagtgtgtattcccaccaccacctcctatggtggcaaatcccataacctccgtgaggagaaaggacttcttcacatttatcaaacacctgcaacgtggcaggcactgtgctgaactgtgtctatgtagattatttaagcttcaagattccccctcaaatgagatcatactacccacattttccagataaggaaactgagggctatgaattttgaaatcactgtctgaagtcacagtgttgggaggcagtgatgctaggatttggacccaggtctgggaagattcctgccactgagcctcagtttccctacctgtgaaaaaaagtgggtgaagaggtgaaatccaagagcagtaaatcttgggacaacttggtggggtcgtggagaggctggggatctgtaaagcatggtggcttggtgtatcattgcagcttcaggaagtggcccgcatcgtgggcaactctggcctcaacatctacaatctctatgccccgtgtgctggaggggtgcccagccattttaggtaggtgctgctgggtgcccctggagccaaccccagccccatctggaggctccacacccattcccccacctcacattgcaggtatgagaaggacactgttgtggtccaggatttgggcaacatcttcactcgcctgccactcaagcggatgtggcatcaggtgtgcgagggcgtgggcttcctcctggtgaggtgggggcagggggaggggcagggaagcagaggccctgacccactgtctgtgccttccaggcactgctgcgctcaggggataaagtgcgcatggaccccccctgcaccaacacaacagctgcttccacctacctcaacaacccgtacgtgcggaaggccctcaacatcccggagcagctgccacaatgggacatgtgcaagtgaggttccgtggccacctgtgacttggggtggtgggttgctggggcttgtgggcatcggcaggtttctcagggatcttctgtgtagagtttctcaatgagatgagctgtagaggatgtttaacatccatccctgacccctcagtggattgagagtcagccaattcattcttttatcttttttaaatttaaaatttttttgtttgagacaaggtctcactctgtcacctaggctggagtgcagtggtgtgatcatagctcactgcagcctcaaactcatgggctcaagcaatcctcccacctccccagtagctgggactacagacgcaccaccacccccaacaagtttttgtattttttgtacagatggtgttttaccacattgctcaggctggttttgaactctggggctcaagtgatctgcccatttcagcctcccaaagtactgggattacaggcatgagccaccccgcccagccccatttcattacgtagccacattggttgttgtttcacagttcactacagcctcaacctcctaggctcaagcgatcctcccaccttagtctactgagtagctgggtctacaggcacatgccaccattcctggctaatttttaaaaaatttttttgtagagacagggtctcactatgttgtccaggttggtctcaaactcttggtctcaagcaatcctccctccttggcctcccaaagtgctgggattacaggcgagggtccccacacccggccatcacattggttaataactattacttccgactgggcgcagtggttcacgcctgtaatcctagcacttttggaggctgaggtgggggaatcacctgaggtcaggagttcgagaccagcctggccaacatgaagaaaccccatctctactaaaaatacaacaattagccaggtgtgctgttgggcacctgtaatcccagctattcaggaggctgagggaggagaatcgcttgaacccaggaggcagaggttgcagtgagctgagatcatgctactgcactccagcctgggcaacaaaagtgaaactccatctcaaacaacaataacaaactgttaacttccatgtccagtctcctgtggccacccccccccacaaccccaagtaaaagggtaacactgggcccagcagggctgctcaggtccattttgattggtcagtgctcacactctaccctgttgtatgttgtgactcccacacctgctggcccctagacactaaatgccagatgcatcccagtcctcgtaacaaccaaaatgcgtcccttgtacatttctttttctttttttttttgagatggagtcttgctgtcactcaggctggagtgcagtgctgcgatcttggctcactgcaacctccgcctcccgggttcaagtgattctcctgcctcagccttctgagtagctgggactacaggcacgcaccaccacgcctggctaatttttgtatttttttttttagtagagacggggtttcaccatgttggtcaggctggtctcgaactcctgacctcgtgatccactcacctcggtctcccaaagtgctaggattacaggcgtgagccaccacgcccagcatccctgtacctttctaaatggtggtgagttgaggctgtctgaatcccagcccatccagcccaacatccaagtcagtcctagagaggtggcccccccccaaaaaggggagtggaacccagctgtctgccttctgggttggagcttggagataggagagaaggtctgatctgttgactacttttcgccccgacctggtcttcctggggcctgctcgtatgttcccggcagctttctggtaaacttacagtaccgccgtctctaccgaagcatgaactcccagtatctgaagctgcttagctcacaggtgagtggggagagcacagctggatcaccagcagccttaggaccccagagtagcacagcaagctgggggcccttgagacttcctgtcaggacaagggaagctgaaactccgaaaggcgaagcccagggtcctgtgattggtggggtcagaatttgaacctgggtttgtccccacccatgctgtcctgctataggaggcctaggggtctgcatcagccacggagtcttaagggtgagaagagcttcattcatgccaaaaatgggccagcagaggtccagggtgggaggagaccttgcacaaggtgatataggaagcactggcagggccaagttaggactaggttctgtccagcacagtggttaatagcatgggctctggagtcacatggcctgggtgcaagtccctgtactagccacataatcttgggcaaatttcttaaatatgagcctcaggttctccatctgtaaaatggggataataatgatatctaccttcacagataaaacatttagtagaatactggacatgcagtaagtcgttagaaaacatgaaaattccctggttcgtgttatctagcttggccccttgaatttcctgaggggtaggccttgaactagggaagggctggggactgggcttgttccacacccctcatttttaccccatcctgctttagaaataccagatcctattatataatggagatgtagacatggcctgcaatttcatgggggatgagtggtttgtggattccctcaaccagaaggtaaggtagagattcctggccctgggataggggctgctgtggaggattgggagcgggtatgcctgggagtggccagctggctgcctggctctggcccacagagggcaagtgtggaggaattcccagccctaaggtcttgctggtagctgtgagcaaggatgcagctgctgtaggctgatgtctttcctggtggggcagatggaggtgcagcgccggccctggttagtgaagtacggggacagcggggagcagattgccggcttcgtgaaggagttctcccacatcgcctttctcacgatcaaggtagggactgggcctgctgagagataactgggccggaggcaaaggagcaggacccacccgtcctttccctctggctgccttttaggctgggtcatgggtcaccatctggcccctgtatgggcaagtttttttggagaggggtggggagggttctgggaagaataaagggtttgggatgaaggaattgcccccgagtgagcagttatatggggaggagggaatggtggggtcaggagctcacgaacattgctcctcagggcgccggccacatggttcccaccgacaagcccctcgctgccttcaccatgttctcccgcttcctgaacaagcagccatactgatgaccacagcaaccagctccacggcctgatgcagcccctcccagcctctcccgctaggagagtcctcttctaagcaaagtgcccctgcaggccgggttctgccgccaggactgcccccttcccagagccctgtacatcccagactgggcccagggtctcccatagacagcctgggggcaagttagcactttattcccgcagcagttcctgaatggggtggcctggccccttctctgcttaaagaatgccctttatgatgcactgattccatcccaggaacccaacagagctcaggacagcccacagggaggtggtggacggactgtaattgatagattgattatggaattaaattgggtacagcttcaaatcccgtcttctctgtggcactgggggttagagggggcactacaggctatgaatgtgggaaaagaggggctgagaggggttggggtcctgaatgacagctgccagcttggggattgagggctcagacagctgctgtggacggtgtgggggcagtggacgccctgacatcagcaggccggttcttctcaatcacctctcgcagccctttggcaaagtggagatcagccccgatggtgaggaatccctgtgttggggagaggggagcctcatttattcattcagttattgaggccagagtttagagatcaagagacagagtgtttgtctttcaggaactcaatctaatggataattccatgtcaaggtgttaaaatgaggctgtaggagtgtagactatgggtgtcaaggagggcttcttggaggaggtgacctctgagctaagacctgaacaattagtaggtattgggatgggagaagagtgctccaagaagtcacagtgtgtgcaacggcttttaggagtctaagattaaaatgggaggggcgactggtaatgggggagctggggtcaggtaatggagggcactggggagctatagagagaggggaaggccctccctccttccccatcctgcccccactcaccgcatggttcgtcaccacctcatgcacaaagttgatgccctcaggtagtgggatctgcaccccacgccaggtccgctctgtgggtgggagcaccccgctcagtctgggcccgcccagttcacccctcctttcttcctccatcctcacaccccagccttaccattgagcatgggcatcaccccaatctgcagcatggtcttcagaggggcctgtaatgggatcagctgggaggggcgagggcggaaacagggcagtgagtcagggttgggtttgcctttagctgcccgcaggtgagcagttatatgaggagggggggatggtgagggtcaggatctcacgaacccagcccagcccacccacccttccccactcacagccagcgactccagtgcagaatggttggaatagattcggaacctgcgggaaagaaaggagccctgtgggcaggaagcctggaagctccccttcctcaggccacccaggcctacctgccagaggtgtctgagttgcaggctcagatgcccacctaggcacctttccaagtgctacaactttccaggtatcctcggggcagtcattgctgccacttgggtctccttttctccaagactgctactttttatttattgagcacctcttttttttttttttttttttttttttttgagacagagtctcgctgtgtcgcccacgctggagtgcagtggcgcgatctcggctcactgctccgtctcccgggttcacgccattctcctggctcagcctcccgagtaactgggactataggtgcccgccaccaagcccagctaattttttgtgtttttagtagagacggggtttcaccgtgttagccaggatggtctcggatttcctgaccttgtgatccgcccgtctcggcctcccaaagtgctgggattacaggcgtgagccaccacgcccggcctttattgagcacttctaatgtgccagacttctgctggtagctttgcaggtgttatttattttatgtaacaaaacttcacattgcttagttcctgtcagacactaagcatatttattttctttttttatttttatttatttttgagacagcgtctcactgtgttgcccaggctggagggcagtggtgtaattttactcactgtggctttgacctccagggctcaagtcagcctcccacctcaggcttccaagtagctgggaccacaggcgtgcatcactatgaccaactaacttttaaatttttttgtagagacaggatctcactttgtagctcaggctggtatcgaactcctggcctcaagcgatctacccgccttggtctcccaaagtgttgagattacaggtgtgagccactgcacccagccaacgtgtttaaaaagttaatattagtaaactgttttaaaatacagtaccaactggtttagtcctcaaaacaagcccaaggagtgggcactattaggatttgcactaatttatagatgaggaaaatgaggccctgcaaggttaagtaatttgcctgaagtcacacagctggaaagtgtcagaagctgcctctagaacctagggtcctaacctacattatctcctttaaccttagaacagcactgtccagtcagattttctgtgaaacgttttgtatctgcaccgtctactatggtagtcactagccacatgtggctaatgaaatgtggcttagtgcaactgaaaaactatttaattataattaatttaaatgtaaatagtcacatgtggctagtatctaccatattggatagcacagccctagaaggcagatgctacttttgcctgtattaaacacatggagaaaatgaggcctagaaagacaaaatgggctgggtgcggtggctcacgcctgtaatcctagcactttgggaggctaaggtgggacgatcacttgagcccgagaattggagaccagcctggacaacaaagtgagaccccatctctacaaaaaataaaatagtcaggcatggtagtgcatgcatgcagtcccagttactcgggaggctgaggctggacgatcacttgagcccaggaggtcaaggctgcagtgagctatgattgcaccactgcactccagcttgggcaacagagtgagactctgtctcaaaaataaataaatacaataaaataaggccaagcacagtggctcatacctataatcccagcactttgggaggccggggcaggtgaatcacctgaggtcaggagtttgagaccagcctgaccaatatggtgaaaccctgtctctactaaaaatgcaaaaattagccgggcgtggtggcgcacacctgtaatcccagctactcaggaagctgaggcagaattgcctaaacccgggaggcagaggtggcagtgagtcaagaccacgctattgcactccagcctgggcaacaagagcgaaactccttctcaaaaaaaaaaaaaaaagaataataacatttttaaaaaagataaaatggcctcaaggtcacaaagctgtgttgtgctgaggtttttgtcaaaacccatgttctgatctttgctgtgtgactgtgggcatgttatttaacattgctggacccatttgttcatctctcataatacctgccctgcctgcctctgggacatgtgagaatgcagaggagtcagactttaccaaagcactttggcatgcattaacaaagacagaccccagctctcagtggcttacaggtatcactgtactttaagcgcaacatccctgtggacaggtgtgattgtcctccaatcactgaggtgcagggaagtgcgcctgcctacctgcgcaggtccagctgcgtgcgcagggccttcccccggagagccatcttggcgctgagacgggcgtcctgcaggaacatggggaggaggatgttactgacccagaaggtcagtaacccacagcccatttttccctgacccccagccagcagcccccactctgggacccgtaccatagtcatgctggacagctggacctcaggctggtctggtgggaccagggcaatggtgacgctagcagtgacagagatggtggtgccagagggcttgatggtgcagcgcggtggggccaggacccgcagctccagcttcaatggggagtcaatcactgctgggctctgggggatgagcagcaggggcgggtcaagtccctgccatttcctttggagcccccagggaagaaggggaaggaaggcaggtgcagcttctgtcctctggggactctcatattgcaaatacagagggagctctggcttccaaaactctcacatctgcatctagccttcatgcctttgccacacaaagaaacaggaatgtgttcttctctttctgcttcctaaatacatctcaatattcaggtctatctccaatccagactctttgtggatgtcctttttgcattagtatctcagcccttgccatgtcttctgtttttgatatggagtctcactttgttgcccaggctggagtgcagtggcacaatctcggctcactgcaactctgtctcccaggttcaggcgattctcccgcctcagcctcccaagtagctgagattacaggcacctgccgccatgcccggctaagttttgtatttttaatagaaacggggtttcgccatattggccaggctagtgattcgcccacctcggcctcccaaagtgctgggattacaggcatgagccaccacacccaaaccccttgccatatctttttgctctctctctcctttttttttgagacagggtctctgttgcccaggctggagtgcagtggcatgatcacggctcactgcagcctcaacctcctcagctcaaattatcctgccacatcagcctcctgaacagctgagaccacaggttcatgccatcacgcctggcttatttttgtatttgttttttgttttggtttttgcttttgtgttttcgtagagacggggtttggccatgttgcccatgctggtctcaaactcctgggctcaagtgatctgccggcttcagcctcccacagtgttgggattacaggcgtgagccaccgtgcctggccatatcttctttctctaaactgctatgccttcttctataggcagtgaaggaatactataagatgcaactgcctaatcttcaccaaacatgattctaaacactgtatatgtgttggttcctttaaacctcataataaccatgtgaggccgatattattactgccaattttgttgttgttattttttacaaatttatttttcaggctgagtcgtcatggcagagaattgcttgaacccgggaggttcaattgcagtgagccaagattgcgccactgcactccagcctgggtgacagagtgagactttgtccccccaccgaaaaaaaaagatctgactaaaaatttatttttcaatagagacagtgtctcactgtgttgcccaggctggtctcaaactcctgggctcaagcaattttcctaccttgacctctcaaagttctcagagtataggcgtgagccatcatgcccagccatatccccatttttgagatggggaaattgaggcacagataggttaagtaacttgtagaggttatgtagttactcagtttcagaactaggcttgaagcccaggcagtctgacaatagagaccctgccctgccataaattggatgatgataatgactgaattatttcttttaaaatttgtaattctgctaggtgcggtggctcacacctgtaatcctagcactttgggaggccaaaaatgggtgatcacttgagcccaggagttcaaggacagcctgagcaacataatgaaactctgtctcaacaaaatataaaaattagcggggtgtggtggcacaagcctgtaattccagctactcaagaggctgaagcaggaggatggcttgagccctgggaggcagaggttgcagtgagcctagattgtgccactgcattccaacttgggtgacaaagtgagactcttgtctcaaaaaaaaaaataaataaaatgtgtaactcttactctcctccccaatacacaaataaacaaaagtatatgtgaattattattaaagccctcacacttgcaaagcttgggttctcactaatcctcacagcagctctgcgaaggagatggggcaggaaggagcaggaaggagcagaccgcttcacagacaggaacagccatgacaaggcgagggggattggccacagacaagaggccagggccctgtctgcgtggctgccactgggggccccacctgcacccctccttggtctcactggtgtgcaggtggccctatccctgcccccgccagcactcaccagcaggacaatgctcccaaagtaggtggccctcagcagcatgtccaggtcgtggggcacctgaacaggggaatcaggagtgagggagtgagctctgtcacagaccttctcttgcccatcccacaaacaggccatgacataccttgtcccccaccagcaacagctgcagggcccccgcccggaagtagctctccatggcagagtcgaagaagaactcagagaaggccacatacaccatccgctcttcctcctgcagctggggctccactgcccggttggggaggctccagttcctctcagtcagggggaagaaggccccctggggtggggcattcacagtcagggtcaaggcagactggcctggcacctggactgacagcaggtgtctcccagccccgtgctaggcactgtggggggatggtgggaacccagctgctgttcttggaggattcacaagcacatctcttaaaaggcattggaaggaggacacctgctaccagggggcgagcccgtcagactggaggagggagggtcaggaaaggtttcagggaagaggtgacatctgagtgggccttgaaagctagaggcagtaacaacagctactgtttacatatattgtgcatactcatgcttctttgccaagtactctaagctcttcacatagatcgacttctttaatctgcataacaacgtgtgttttcttactagattatttccatttacatgttaggaaactggccaactgaaaacttatgcttagggccgtgcagctagtcagtggcagagctaggatttgaacttcaggcattctttttctctttgtagagaaggaggtctcactatgatgcccaagctggtctcaaactcctgggctcaagcgatcctctcgcctgggcctcccaaagtattgggattacaggcatgagccactgcacccgactgattctagctcccgagtctgcactctgaaactgctatactcctctgggagaccaaaggtagtggctacacactggctatgtggccttgggcaagtgacgtcacctctatgagtaagtctccacattcctaaaattaggatgatgttagtacctgactcacagggttgtgagagaatgaaatgagattatttgtatagaaatttatgtccagctccttcgggggagttggggaaaggccgtgcatgagcaaaggccctgaggtgggaagccagggtccaatttgggaaagagcagctgcaaagaaacaggatgagatataaaaggtggggccaggtaagattaacaggggctcaaatgccagacccaggaggctgaacctaattctgtagtaacagggagccatagcattctcagtaatgggagtggcctcatcagagctgtgctttaagaagtaaaatcttgcaacttagcagagaaagaggtcttgttaggaagtcagaggtcatacaccagcccaagcagctcacccggaagtccatgtccaggttgctggtggaagccacaggatccttcatgagggaatagtcaatgccaacaagctcgtccacagaactgcgcactgcaggaaggggctcaagtcactcacggctgtgtgatgtgggataaggtgcttaacctctccaggctcagaggcccacccataaaatgaggatacatccttcacagggttgtcatgagggtcaaattagttttatgtggaaagcacttagggcctggtgtgtagttaggtgctcattaatgttagttattattattactaccactatagaggtttcaaaaaaataactaaacaagatggcatgggggggccgcgcatggtggctcacacctgtaatcccagcacttagggaggtcaaggcgggcggatcacctgaggtcaggtgttcgagaccagcctggtccaccacggtgaaaccccgtctctactaaaaatacaaaaattagttgggcatggtggtgggcgcctgtaatcccagctactcaggaggctgaggcaggagaatcgcttgatcctgggaggtggaggttgcagggagccaggattgcaccactgcactccagcctgggtgacagagcgagactccatctcaaaaaaaaaaaaaaaaaaaaaagatggcatgaggttcctttcccttggtttctcctacctcctccttcgcttcccatgcctgtgtgttaggtgtgatgggaaaatacctttgccccacagtagacagaggtcatggcttagaaaaagggaattcatggccaggcacagtggctcatgcctataatcccagcactttgggaggccaaggtgggcagatcaggaggtcaggagatcgagaccatcccggccaacatggtgaaaccccgtctctactaaaacacaaaaaactagttgggcatggtggtgcacgcctgtagtcccagctactcgagatgctgaggcaggagaattgcttgaacccgggaggtggagattgcagtgagctgagatcgcgccactggactccagcctggcaacagagtgagactgtaagactccgtgcaaaaaaaaaaaaaaaagaaagaaaaagaaaaagggaattcatgttaattgagcacctattagatgctaggtgatgaagacaaatgggatgccagtgatcagcatgcacatattgaggaccttgacaactattctctcagataatcctcacagcaaccccaggaggaggcactgccagccaagtgaggaaacaagcactttgcccagacagaaatgagcacttcacccaaaatcgcacaacaagtcagctccaggggccacatttgaacccaggactgttcaacagcagggctcggaaggggcctgctctgaggtgctgcatgacagctgcacacccagactcacccgccaccaactcaccaggcacggtgtccaggagggagttgagcaggaccgtccctgcgtggtagaggacagggcagatctgcgaggtgggagccagagtcagggccttctcaaagtgagagcatgcccacccttgccaccctgcgacctgtcgctgcccacacctgctggttgaggaggaagcgcatccctgaggtgatgaacgtggagagaaaatcatacaccttcctgtgaggagaggagaggccggatgagcccagaacctgcctccaccccagtccaggtccaggagaaatcagtgactagggaaatagtggcagtaggagtcctcagcttcagcctgaataacagctcctccacgtaggttttccaagaaccaggcccaaattccctctccagtctaattctcaagacctcctgacctactctctggtcccatcagtcaaatgaatccacccacattgcctcaaacccactctgagcatccccacatccatcggcttactgatgccctcccttccgccctctgcattcctactctgtattttcccatctgagctcagatgcttcctcttccaggcagtcttcccagattcccctcctctgaatccccaaagcattttcttagtccttctctccaggccctgatatcaaatgttttttgctccagataggctctgagctccttcctgcatcctcagggactggcatacactttgtttgatgaataaataatactgacagtgtaccaacaccaggttataatccatcatcttctctcccccatcctcttccagaacaagaacaatatccccttctcagcagcaaaaataaaaaaataggccgggcacagttgctcaggcctgtaatcccagcactttggtaggccgaggcggacagaccacctgagatcaggagtttgagaccagcgtggccaatatggcgaaaccctgtct[133 bp omitted]cactccaggctgggtgacacagtgagactccctctcaaaaaaaaaattattatttttgttattattatttagagataccaattattgagaatccagtacatggccaaatgtgcatatcagatagtcctcacagttactcttatctaagtggccagcacttaaatatacatttatcatatgccaggtgctgttctaaatttttttttttttttttttttgagatggaatcttgctctgtcaccaggctggagtgcagtggcacgatctcagctcactgcaacctccgcctcccgggttcaagcgattctcctgcctcagcctcccacgtagctgggactacaggcacgtgccaccacgcccagctaatttttgtatttttagtagagatggggtttcaccatgttggccaggatgatctcgatctgttaaccttgtgatccgcccgcccagacctcccaaattgctgggatttcaggcatgagccaccacagccagccttgttctaaatattttttacatataccaacacaaataatcctgacaacgatcttataaaataggatcttataaaatgaggatattgaggcaccaagcttcagtgacttggccacgttcacacagccaggaagtgacagagctgagctttggacccagttggtctgattcccaggcctatgcactttgcattgcgctaggcagatgagctgtggggctcgaaaagggtgagctggggttggggctggggcttacttgaaggttcccccgaaggccgcgtgcattctggagacagaggcctggcaggagacattggacactttcatccgtccagcgggatcccgggagagctccagaccagtgcggatggacacaccctcagctgaggcgttgatgtagcccccatcatagctgccaggggggttaatattcactccaggtaggagctcaattgagtcttcagtgcccccatgcatcaccatacctcttaataaggtttcacctctttccacacatcctaccaaaccttcctatcaactcgtatgaaatgcatatgcctgtttctgttacacagatgaagaaacggaaactcaggaaggctaagggggctgcccacagccccacagcacctccagccctcctgacccactctccactcccctgagggtgctgggtccttacaagaaccagtagagcagctgtctccggaagcgcagccccaaggaggcattggtgatttgaagcatcagctcctgctgtggctggaaatcgagctcggaagatgtcagttgcagctctgtgaccttcaccctacaggaggcctcagggtcagatccagggccaagaagagggaacttcccccaacgacaggaaatttgtctgctcccctttcaagtccaggcctggggaagcgggagtgggtggaatgaattcttccattgtccctcaagtgcccaacttagacttgggtggctcaaagttgaacttgggtggctgagagaggaggtcttcctgatccaggtgttaaaaatgagcttcaccccatcgcttaaaagtcttgtttgtttgtttgccaggtgcggtggtggctcatgcctgtaatcccagcactttaggaggccgaggagggcggatcacttgaggtcaggagttcgagaccagtctggccaacatagtgaaacccgtctctaccaaaaatacaaaacttagcagaccgtggtggcacgcgcctgtagtcctagctactcgggaggctgaggcaggaaaatcgcttgaactcgggatgcggaggttgcagtgagccaagatcgcgccactgcactctagcctgggcaacagaacaagactccctctcagaaaaaaaaaaaaaaaaagtcttgtttgcttgcaccccctcccctcccacaccctggggttgctacacccggtcttttaatagagtccgttcactttgcctccatcacctaagctccgtctcacatctcaattccttattccccctccctcatcctaaaccatacttagagccttcagtttctccacccctccgattaactccaccccgtgcccgagactccactctcatctattgggaagttccttgactccacctttctgttgttcttcgaccacgcctcacatccactggtcctgcttccttcttggccccctctacattttcaaggccacgcccatctgcctggtcccgcctatgatgactggcttggcctttatcttttcggccccatccggtttcttaagtcttgcctcatcgatttggccacgccccatcccactcagcctccagtctcccgagaccctgagatttctcgggccccgcctccaccgccgaggccccgccccggatcgcgaggccccgccccccacttactcagagatgttgtagtagaagtggccttctttgccccgcaggtccggaatggtgatagtctccagctcttgctccagaaagcgcagcccctcctgcttcactgaagcagcagagaaacccttacttagctcccgtgcccactgttggggcgaccccaaccccgtccgctcccgtccgtccctgtctgcccctgcgccttacccagctccagcgccttggaggtgacgcggatcttgcagcctgggaactctgcatgtgcgcctgccagcagcgctaggaagagggccccgaagagggccatggcgagcgggcctgggggtggggtggggtcgcaggagttatctgagccgcttaaacccattccttggacgtccaaccataagtgggaactagcctggatcgttaccctccagataactcttcggggaacttggaaccaataatcttgcctccatatggcagatgtggaaactgaggctcagagaggcgatgcgacttgcgttctggctcccagaggatttgggacacgggggaggggacgttcccagttccctcgtgctaccgccgcgtgatgagtttggacctccaggggaccagcccccacacccccaacaacctcccctttcctttagcggtgggcccatgcaggcttgcacgttgccacggcaacgactgcacgcgcattcttggagggtggcttgcggtctcataggcctcgcgcccggggaggagaggaggtggccgaccagaccgtgggctcccgggtctcccggctccctcaggtcctaaatctctcccattagagattctgcctggagcccccatgttagcgttctccttcatcggctctcctccccacgccggcttcagtgcaccacgcggctcggcgagggactgggaacgggatagggacgcgccccaactcactcagcggtggagctggggggcggcgcggtcacgtgggatggcgggcagctcaggggatccgggcgacggggtctggcgggcagggttgttccagccgcctttataaagccggcctccccgacccctcctcctctctgcagctctcccctcctcccttgggggctgggaggggacggggcgggacgctggcagccgggagagtggaaaaggctgcacagagccccgtgacaagcccggccgctgtctggacaagtgggagacccaagcccagggagagggaaggaaatgcaggagccggcccactcagccccaacaatcccactttgctgggaccttggttcaaattacaattatccatgtcttcctgcatgatcttgggcaagtcacttcacttgggtcactgaccctcagtttcttccttcagcgaaatgtgcacgatgataggaactacctcttgggcctttattacaaccaggtccaggcacaaagtcaaggaatattttttctttccctgccacccacaatcatctcgggacctccttgcctggctttgctatgggcccccctacctgtctctgtgtcaccacctggggaccttaaggtcccagagacctttcccacttgggaaagcaagactagacaagtgctgtcagcccaggaacataccacaccggctgaaatcagaaggaggtctgccatttatcgtggctggtggattgttttttctattttttttatttttattttttgagacggagtctcgctctgtcccccaggctggagtgcagtggcgcgatctcggctccctgcaagccccgcctcccgggttcacgccattctcctgcctcagcctccccagcagctggggctacaggcgcacgctgccacgcccggctaattttttttgtatttttagtagagacggggtttcaccgtgttagccaggatggtctcgatctcctgaccttgtgatccgcccgcctcggcctcccaaagtgctgggattaaaggcatgagccaccgcgcccggtccactggtggattttttaatgaacccttggagcaaggtgctctgaacagcatccccgcccccacccccacccccacctccatctactgcttacagggttcccggaccctaggacagggcacagagtgggtgcttgccacctttttgttgccaaatggacgaaagaaaggggaagcaataatcatgtctgctgagcatgtatttagcaccaaacactcatctaggaaggatgactaactcatcctgatttgcctaggactttccccattgtgtcttttttttctgatataatccacagattcacaaaaatagttccatttccttttttatttaattaattaattaatttttttgagacacagtcgtgctctgtcaccaggctgcagtg[133 bp omitted]acagggttttgccattttggccaggctggtcttgaactcctgccctcaagtgatccgcctgccttagcctcccaaagtgctgggattacaggtgtgacccaccatgcccagcctatttatttatttttatttatttatttaagatggagtttctctcttgttgcccaggctggagtgcaatggcgc[131 bp omitted]tttcgctatgttggccaggctggtttcgaacgcctgacctcaggcaatccacctgccttggcctcccaaagtgctgggattacaggcgtgagccaccgcgcccggccgcctatttatatttttagagacagggtcttgctctgttgcccaggctggagtgcagtggtacaatcacggctcactgaagcctccacctcttgggctcaagcgatcttcccacctcagcctcctgagtagctaggactacaggcaggtggtaccatgtcatgtccagctaagttttgtattttttgtagagacaggtctcaccatgttgcccaggctgatcttgaactcctggacccaagtgatcctcttgccttgggctcccaaagtgctgggattacaggcgtgagccacacatccagccatccccattttgaaaccattcctgggaacccactcagtccctgggaaaccttacaactggtcatccgaattctaggtaatttatttaaccttaacaacctgtcagactggcactattatgaaccctctttaacaggaagtagaggttgaagcaattctgtggctgctattagggaatccgtagactgttcatggaagagtggaaggtgggctttatagcccggtagttatgtacttagactcttgtgtctgacagacaagagtttacaccccaggttgtcagttcttaggtgtatgacattgatcccttgcttaagcactcagatcttcaatttcctcatcctaaaatggaaacaataatttaaggttattgcaagaataaatgggcctggtacatgacacatcattagtgccaaataaatgctagctatcttaattaggggcacataccacgagcaaacaaagcagaaaaggtgtagagggagaacagagaaagtgttaagagtatccagaggaggaagtatctgtgttcctttgaactctagtaaccttcctagagcctggctcaagcagaaaacctggtggatgttagttttctttcctcttatttcctttcttttctttttttttttttgtggggtggagtctcgctctgtcacccaggctggagtgcagtggcacgatctcggctcactgcaacctccacctcccaggttcaagtgattctcttgcctcagcctcccgagtagctgggactagaggcgcctgccaccatgcccagctaatttttgtatttttagagacagggtttcaccgtgttggccaggttggtctcgaacttctgacctcaggtgatccgcccgccttggcctcccgaagtgctgggattacaggcatgagccagtgcacctggcccttttttatttttttttaacaacaacaacaaaatacattttatttatttaagatagggtctcaccatgtgctcaggctgatctccaactctcgggctcaagcaatcctcccacctcagccccccaagtagctgggactacaggtgtgcaccaccatacctggctgttttctcttcttttctttctttttttccctcttttttgagagagggtctcattctgttgcccagactgctgtgcagtggtgcagttacggctcactgcagcctcaacctccccaggctcaggtgatcctcccacctcagcctcctgagtagctgagactacaggtatgtgccaccatacccagctaatttttgtatttttcacagagatgaggtttcaccatgttgcccaggctggtcttgaactcctgagctcaagagatctacccacctcagcctcccgaagtgctggtgttacaccacatctggcctttcctctcgttttctttttctttttttcttttttttttttttttttgagacagagtcttactctgtcacccaggctggagtgcagtggtgctgtctcggctcactgcaacctccacctcccgggttctaagcgattctcccgcctcagcctccagagtagctaggattacaggcacacaccaccacagctgactaattttgtatttttagtagagatggggtttcaccacgttggccaggctggtctcgaactcctgagctaccaaagtgctgggattacaggcgtgagccagtgtgcccagccttgctctcattttcttaggtgaaatatttctcgctatattgcccttgctggtctcaatctcttggcctcaaaagatcctccgatcttggcttcccaaaatactggtattacaggcgtaagccactgtgcctggcctcactcttcctggctttgaagactgaaggagaggcttcccagcaatcaaagggatgggaaagaaatgcttttctagcctcagttgtgtacccagatgaatccaggcttcatctttgtatcatttttatctcttaaatggtcttgtcccatgcaattcactggccagtggcctaacccctctggatctcagtttcctcatctgtaagatgaggatgatccaggtacctccctcttaggattgcttgtgaggattaaatgagttaatgcattgaaagggtttaataagtacttggcatttcctaagggctcaaaaaatgttacctacaatcattagcatgatcagccatcagtggcttttcaccatactggaatagactcctgcctcagtaccctgattccctggcatgtgatagggcctactctctctgtctcacctctcacctctcttgccctttgcattcggctccagccaaactggtttttctgttccttgaatgtgcaagttcttcttgctcagagcctttgcatttgctgttccctctacctggaatgcttttccacctgatcttccttgtcattttgtctcagcttattttatttatttattttttgagacggagcttcgctctgtcacccaggctggagtgcagtggtatgatctcggctcactgtaaactctacctccagagtacaagcaattctcctacttcagtcttctgagtagctgggattacaggcgtgcaccaccacgcccagctaattttgtatttttagtagtgatggggtttcacatgttggccaggctggtctcgaactcctgacctcaagtgatctgtccgcctcagcctcccaaagtgctgggattacaggctcgagccaccacgcccagcattttgtctcagtttaaatggcgttttttcagagaggccttccctgcctgcctatctattaatcgctctcaatcatatcagcctggtttattttctttatagattttattactattgaatattttctttcttgtttgttgtctgtccccgtgagagctggaattttgttcaacactgtgtccttagtgcctagaaccatgcctggcacacagtaggtactgactaaatatttactgagtgattgaactggtttggagtccttgaatgtccctgggcagcaggcgatccctatgccaacccagatcctttatctcctcctgtaccatgttagcctcagttcaattgaccctaaacacagctctgaccggccgggtacagtggttcatgcctgtaatcccagcactttgggaggctgaggcaggtggatcacctgagttcaggagttccagaccagcttgaccaaaacagtgaaacc[136 bp omitted]cactccagcctgggcaacaagagtgaaactctgtctctaaataaataaataaatacagccttgacctgggctggtggaggagaaggtgcagtcactggccctgaatccagggccttccccactcagcctgtccctctttaatacattgatttcccttttcctctaaaacatatggtgcacacaaccctcaaacgttaagagtgatgtcagcagatgtgcagcgtgggatgggctctggcagcctcctcgagtgctcatcaccgggcttgagacatggagagagccaaatccccaaatcccttcccactttcactcctggttttgttgttgtttgtcttttgaggcagagtctggctctgcctattaagctggagtgcggaggcacaatcttggctcactgcagtcttgacctcctgggctcaagcaatcctcccacctcagcctcctgagtagctgggactataggcatgcaccaccacggctgattaatgtttgtaattttttttttttgtagagatgaggtctcactgtgttactcaggctggtctccatctcctggcctcaaggaatcctcccacctcggcctctgaaagtgctgggattacaggcatgagccactgcgcccggcctcatccctggctttgaagagagaaggagaggcttcccagcactcagagggacaggaaggaagtgcctttccagcctcagttgtgtacccagcacagcaatactggtaagaaatcaagatagcaaagtcctgcttctgcctttttctagaacagatgtcagcaagctgttcctgtaaaggaatcaggatagcaaagtcctgcttctgcctttttctagaacaaatgtcagcaagctgttcctgaaaaggccaaagtgtacatattttaggctttccacaccctgtggtctctatcgcagctgctcagccctacactttagcatgaaagcagccataaacaatatctaacgaacaggctgggagctggagttagcacacaggccatagtttaccaacccctgttccagaggaaatgaaaaatctctttctgggctaggcatggtggctcatgcctataatctcagtactttgggaggctgaggcaggaggattgcttaagcccaggagctcgaggctgtagtgagctatgattgtgccactgaactccagtctgggtgacacagcaagatcctgtctctaaaaaaaaaaaacactttttgaacctcagtttccacatctgtaaaatgggatgatctagtacttacctacctccctgggtggcagtgaggatttaaagtgataaagtatacaaagtgtggaacctagtacttggtggcggggtggggcgctctcactttgttgcccaggctggtctagaattcctgggctcgagcgatcctctcgccttggcctttcaaagttctgggattacaggcatgagtcactgtgcctggcctgattattagtattaatagttgtcatagttgcttaacaaacagaaagtgcttttttgagacagggtctcactctgttacccaggctggaaggcagtggcacgatcatggctcactgcagcctcatcctccctgggctcaggtaatcctcccatctcagcctcccgagtagctggaactataggcatgtaccaccatgctcagctaacttttaaaatttttttgtagagatagaatctcactgtgtagaccaagctgatctcaaactcctggcctcaagcgatctgcctgcctcggcctccctaagtgttgggattacacgcgtgaaccaccacacttggccagaaagtgcttccacatattaactcacttacacttcataacatcctacaagataggtatcctcacccccagtttacagataaggaaactgaggcccagcagttataagctcaagtcagtctggccccagagcctatgcttgtaactaggtttctctctctgtctctctctttttcattatcccatgtaactctcacagcagtgccttgagatagctattattggccctgttttgcagatttggaaactgaggttcagtacgaggaaataactggtccaaggaagtaaacacgggctccactgaccacaggaggccaagctggattgctgcccaacatgtcaacatgcactgctctggccccctcctccctcgctgtgcctccagctgtgttttctttggatctctgcatggcttggagaagctgcgtcagcccatctcctctcctgcccagtccccacccccaacgcccaccccagctacccctcagggagtgacccccttctcctcactctgcctgagcatatgagcactgcagctcatgcgcctgtgttggtcagcatgggtgcacctggggacatgtgacaggggacccagctggaatgagaggaggattatctgaggaggacaaatctcaggccaggaagaccccgattacatctctccagacaggcgaaatgatcatctgtttccagaatgcaactggacaaaacagtccgcgtgagggctggacatttaccaaatgggtaaaaggaatctaaaagggctggggcttgctgagttcagccaggccaaagctgtggactgactttccgtgatttctaaagctgggagatctgttgttttcttctttctttcccatttcctccttgaaggccagtccattttctgtgtgaagaacaggccacttggtgtctgaagtcacctccagattagaaactcaaggattctaaggttccttatgaggtgttgctttccctgggtcctcggtcctagggcattgtatccccacacctggtgcctctccatcagggctcggatgtcagccttgggcagctcactctctctctgacttcccttttcttttcttcttcatatcccacccttcttcccagtttctatgcctctgtcagtctgctagctgactctgactcatggggacctctttctgtggtcctctaagcctcctaaccgtctgtgctttccttatactccacgtgggctttccagcctctacttgttttgaggaagaggtggaggatccatagcagctctgtctagatgtttggatttcataagccagtcacaacatttcaaagtaagtgaagggagggggccccaaaggaagggattttttcctttgataataaggataggccaccatcttcagcctaagcttgtcccttttctgcagggcttgctgaaatgttgcaagaagtggtcaacataatgcaactcgaatttttccaggtgtcctaatactgcaggagtcccccgcataacccaggctttggtctaacaagattgccaacccctagccaggaatcatgaggatgtcaccgccctctggccttcttcctctcttccacccagctagatccatattttagctcccccccaaccctagcaagtaccaaatcctgctccttttccaagcttccccatcacaggtcatggcaccagctttatgcagtgctcaagtcaaaaatataggagtcatccttgacttcctttttttgttataccccacatcagcaaatcccggtgtctctaactccaaaagacgcctcaccttatgcctgtaatcaaagcactttgggaggctgaggtgggaggatcacttgagcccaggggttcaagaccagcctgagcaacatagtgagactttgtctctacaaaaaataattagccaggtgtggtagcatgcgccaatagtcccaactacttgggaggctgaggtgggaagatcgcttgagtccaggaggtcaaggctgcagtgagctgtgattgcgccactgcattcccgcctgggcaacagagcgagactctgcctcgaaaaaaaaaaaagatgccccacatctatacaattctctctatcagcaccaacaccacttcaagccattttcattggttaccgggacaacctgccttatctccctgtctcaccatttctcctgtaggtctagcctctctacatcaatctaagtgatatttttaaaaatgggaatcatagaatttttctatcctgctcaacatcctccccatcacacacaaaataaaacccagactctggccacgacctctggaaacactgcaggtgaactagctcctgcctaccttcctctccaagcccatcttctaccactgttgggaacacaccaagtgccttcagcctcagactttccttaattcttttctccaccagacacatcatcccacacacatacccatgcagagttactcagatccctactcaaatgtcacccccacagaagaggccccctctgtgtcattacctgtcattctgtttgtttaattctttattgcctgtttcttccagtagactgcaagctccccagggcggggacaggagcctgccactcttattcatggccatatgtccagtgcccagcacagggtctggcacacagaaaatgctcaatagatgtttgttgaattcaagatggccgggcacggtggctcatgcctgtaatctcagcactttgggaggtcgaggcagacagatcacgaggtcaggagttcgagaccagcctggccaaaatggtgaaactccgtctctactaaaaatacaaaaattagccgggcgtggtggcacacacctgtagtcccagctacttggaaggctgaggcagaagaatcacttgaacctgggaggcagaggttgcagtgagctgagatcacaccactgcactcccgcctgggcaagagagcgaaactccatctcaggaaaaaaaaaaaaaagatgtttgttgaattcaagatggggtgttattatcatccctagacccttcagaaggagcagcttttatggtgcactctgtagccctgatctaatccccggctgagcctctaagctctatgctttctgctggtaccacccatttccttgcatttagccggggttatctggagctggtctgcagccaagaatgtcatactttcctaatctccccagaggcctgagagacgcctaaggtcatgggaggtgcccccacaggatctcagtgggctgagcagaaatcgggactccttgacctaacccacccccaggccccttctacctcaccttccagcaggctcacgcctgtaatcccaacactttgggaggccatggtgggcgaatcacctgaggtcaggaggagttcgagactagcctggccaacatggtgaaaccccaactctaccaaaaataaaaacattagctgggtatggtcgtgggcacctgtaattccagctactcaggaggctgaggcaggagaattgcttgaacccaggagacagaggttgcagtgagccaagatcgcaccactgcactccagcctgggcgacagagcaggactccatctcaaaaaaaaaaaaaagttgaacacaaatttaccatacagcaatttcgctcctaagggtctacccacagaaaaggaaaatgaatgcatttgtacatgaatgttgatagtagtgttattcgtaatagccaaaaggtggaaacaattcaactatcaattggtaaacaaataaaatatggtatatctgtataatgcaacactattcagcaataaaaaaagaatcaactactgatatatgcttcaaaatggatgaagctcaaaaacataatgcaaagtgaaagatgcaagctgcaaaagactacatctgtgtgattctatttatatgaaatgttcagaaaaggcagctctatagggacagaaagcaggccagtggttgctgggggctgatggtgggaacaggaactgactgcaaacaagcccaagaaatcttttagggtaatggaaatgttctaaaacagaactgtgttgacaattgtataactctatacatttacttaaaacaaattttatttatttatttatttattcattcatttttgagacagagtctctctccttcccccaggctgaagtgcaatggtgcaatctcggctcactgcaacctccgcctcctgagttcaagcgattctcctgtctcagcctccccagtagctgggattacaggtgcctaccaccacacctggctaatttttgtatttttagtagagacagggtttcaccacgttggccaggctggtctcgaactcctcacctccaccctcctcagcctcccaaagtgctgggattacaggcgtgagctaccgtgcccggcctattcatttacttattattattatttttagtagagacaaggtcttgtctgggttggtctctagctcctgggctcaagcagtcctcctgcctcagcctcccaaagtgctgagattataggtgtaagccactgtgcccggccagaattgtatatgtatttatttatttatttatttttgagacggaatctctcccaggttggagtgcagtggcatgatctcagctcactgcaacctccacctccctggttcaacgattctcctgcctcagcctcccaagtatctgggattacaggcgcccaccaccacgccgagctaatttttgtatttttttttttttgagactgagttttgccgttgttgcccaggctagagt[140 bp omitted]tcgccatgttggtcaggctggtcttgaactcctgacctcaggcgatccgcctgccgtggcttcccaaagtgctgggatcacaggcgtgatagaattgtatactgaaaacaagtgagtcttgtagtctgtaaattataccctaataaagctgttaaaaacattttcctagctcgggttgagatctctgggttagatgtgtcctgggaacccagctgggacccaggctgggtggggtgtcctcctttctctcctttctaagtcagttttctgtgatctcagactttcaggaagctaccagctgtcgctcttgtttcttttttgaagaagtctggaattctgcagactcagctcatatgggagtaaacatcctggctcttggccactctgactgaagtgcaaaaatgagcatcacggccgggcacggtggctcacgcctgtaatctcagcactttagaaggccgaggcaggcggatcatgatgtctggacattgatactgtccttgccaacatgatgaaaccccatctctactaaacatacaaaaattagctgggcatggtggcatgtgcctgtaattccagctactcaggaggctgaggtaggagaatcgcttgaaccagggagttggaggttgtagtgagccgagatcgcgccactgaactccagcctggcgatagagcaagactgtcttaaaaaaaaaaagcgcatcacagggaatgggtgggagagtggaggggaccaccacaggtggcccacccctatcttgatatgaccaaacgccgcctgggatgctgagcactaacccagagcaaggactgaatttggactccagggtcctggtaggacctgcacctcccttgctccctggctgtgctcaggttgaccagctctccaaacacaccctccctttctatacctccaggccttggcacacgctgtgccctccccttttccttgcctacctggaaaatctatttttccaataagaatctgttcattgtcatctcctctgaagctttctcctttgtgtgcccaccacccccagcccctgccatccctccagagccctcatctccctgtggcagagggttcatgtatatgtctgcctcccacactgctctgtgggctccctaagacaaaccgtctgtccgtcttacttatcgcttattctcaagactctaggacaggccaagggaagaaatggagggaatagtacaccacatcagacgcttccaaggccaggaagaccaagggagacgcccccattcctctcatctattcttggcctaaatggcttctctcatctggtcccagaatggcccaagagccactccctgtgggaaccacagtttggggtggaagcctcctttccacagctttccgggggccagacccacttgccttggaaactccctttgcataatttaaactgcagtgtagggtccatggccagctcaagcccagcctaggcgggggcaacctggagtgggatccagctagagtctcccttccccagctgccaggacctcaggggatgaaagttccctctcagcagcttcttgctgcagtggcagagaacaagggggttaagctatgtggcaacctgagctggttgtttatgtttctgctttagtgtggaggcttggctttgtccggagttgaggcaggggtcctcagaggccctggcagctagtgaccagccaggagtggtgacataattttcagggctagggccggacatgatgggtcacgcctgtaatcccatcactttggggtgccaaggtgggtggatcacctgaggttgggagtgtgagaccagacttgccaacatggtgaaaccccatctctactaaaaatctaaaaattacctggacccagtggcacgtgcctgtagtcccagctactggggaggctgaggcaagagaattgcttgaacctgggagggggaggttgcagcgagccgagattgcaccactgcactccagcctgggtgacagagcaagacgctgtctcaaaaaacaatattcagggctcagggcaaaatgaaaacgtgggacttttgttccaaaattattaagatttttaagatggtgacagtagaacattaaaccaaacacagacttttcttttttattattatttttattttcatcttgtttttattttttgagacagggtctagagtgcagtggtgcaatcatggctcactacagcctcgaactcctggactcaagcaatcaccccctgcgtcagcctcccaagtagctaggactgcaggagcacctactatgcccagctaattattactattattattttatgtagagatggggttctatgttgcacatgctggtcttgaacttttggccacaagcaatcctcccactttggcatcccaaagtgctgggattacaggcatgagcctccacacccagtaagcatgggcctttctaaatctatgcagccggccctggtgccagggagaggagcccagcttattccaaccacctctctcagcccagacctattgtctacccaggcttcttagttcagaaaagtagctggagaaatggaaagccttaggatctttgctcaactgctcatccctatattgggaataaaagactccaggctactgacagagactcggccacagcaggcagcccacagggtgctgccttggtgttcccaccacagaaaccagagcctggaatagaaacggggatacctggccaggcacagtgcctcacgcctgtaatcccaccactttgggaggccgaggcaggcagattgcttgaggtcaggagttcgaggccagcctggtcaacacggtgaaacccccatctctactaaaaacacaaaaattagctgggcctggtgatgtgtgcctttagtcacagctactccggaggctgaggcaggagaatcgcttgaatcctggaggcagaggttacagtgagccaagatcacaccactgcattccagcctgtgcgacagagggagatcctgtctcaaaaaataaataaataaacgggctacctgaaaaagccacctagacttcaacccagagtggtctgttcatggtcatcaaatatttacagagggtcaggcacagtactgagcatggggttacaagggtgaataagccccaggccccacccttaagcagcgcacagcctagtggatgaggaaaattgacaaacattatgagcttagaccattgtggtagtacaagagagggaacctgtcctagccggggtagaaggaagttcagggaaggctgcctggtggaggcgacatctaggctaagactcgaaggctgaattaggtcaagaggggaagaagagtaagggcaaacagcatatgcagagactcaggagctggacacggtggctcatgcctgaaatcccaacactttgggaggctgaagcaggaatattccttgaggctaggagtttgagaccagcctgggcaacatagtgagatcttgtctctacaaaaaaaaaaaaaatttaatgagccaggtgtggtggtggtgtgctcctgcagtcccagctacttagggggctgaggtaagaggatcacttgagcctaggaggtcaaggctacagtgagcctggatacaaatggagactctggctcaaaaacgaacaaaacaaagaaagaaataaacaaaaacacaaaggatcagggtcatgaaagaacctggcacatttagggaaattatgaagtagttcatggtagctgggactggatcaagaagagatggtttgaaggtccagatcatgaataaaatgaatgtgtgtaaagtgcttgacgttgtgcatagtaaatattctgccatggtagctcattataattctggttttgtaggccaaattaagggtttgggattttgtcccgtagtcaatggggagacattcaagagctttaagcccagagtgacttgatgagatttgctatatggccagatccccgtggctccttggtggattatgaactagaagagaagcaaggctggaggatcagaaggccactttgaaaattaacaggtatggccaagcacagtggctcacacctgtaatcctagcactttaggaagctgaggtgggagaattgcttcagcccagaagttagagatagtcttggcaacatactgaccccatctctagttaaaaaaaaaaagagagagagagagagactgggcatggtggctcacacctataatcttagcactttgggaggcagaggcaggtggatcgcctgaggtcaggagttcaagatcatcctggccaacacggtgaaaccctgtctctactaaaaatacaaaaattagccaggcgtggtggcgtgtgcctgtaatcccagctacctgggaggctgaggcaggagaattgctggaacttgggaggcggaggctgcagtgagctgatattgtgccatggcactccagcccatgtgacagagccagactcaataaacaaataaataaagccaggcacggtggctgatgcctgtaatcccagcactttgggaggccgaggcgggcagatcacttgaggtcaggagttcgagaccagcctggccaacatgcagaa[134 bp omitted]ctactgcactccagcctgggcgacagagcgagactctgtctaaaaaaataaataaaaataaaaataatttttagaaaagaaattgagaggtatggcaggtgggaggcttcacttatatcccttaacaatagagtagataaacatacagtggaaaacaaaaaaacagcaatgaaaatgaactcaccacagctatatgaaacaacataaaggagttttgcaagtgtattcttgtgcaaaagaaggcagacacaaaataatactgtataattcaatttacataaagttcaaggaacagacaaaacgaaactacagtgtttagggacacattctcaggtggtacaactccaaaagcaaggaagcgattatcacaaaagtagttggaacaccaattaccctgcagaggtcttctgcttgactgttcagtaccatggcatgggtgatgctaacccaggctcactttttgataaatcattaggttttacatttatgttttgtgcacttttccatgtgtgctattctttttttttttttttttcttgagacggagtctcgctctgttgcccaggctggagtgcagtggtctgatctcggctcatcgaacctctgcctcccaggttcaagcgattctcctgcctcagccttctgagtagctgggactataggcatgcaccaccacacccagctaatttttttgtatttttagtagagacgatgtttcactatgttggccaggctggtctcaaactcctgaccttgtgatctacccgcctcggcctcccaaagtactgggattacgggcgtgagccaccatgcccagtctattttgtatacatttttttgagacagggtcttgctctgttgcccaggctggagtgcagtggcatgatcatagctctctgcagttttgaccgcctgggctcaagtgatcctcccacctcagccccctaagtagctgggactacaggtgtgtgcttccgcacctggctaatttttgtgttttttgtagagacgcaggtttcaccatgttgcccaggctggtcttaaactcctggactcaagcaatccacccacctccacctcccaaagtgctagaattacaggcatgagccactgcgcccagctatgtttaagacacggtctctgtcgcccaggctggagtgcagctaactgcagcttcgacgtccagggctcaagtgatcctcccacctcagactcccaagtggctggaattacaggcccatgccaccatgcccggctaattttatttaaaacatttttcagagacagggtcttgctacattgcccaggctggtctcttaactcctgacctcaaggtatcctcccactttggcctcccaaagtgttggtgattacaggcatgagctactgtgccagtctatcatacactattttttttttttttttgagacggagtcttgctctgtcaccaggctagagtgcagtggtgcgatcttggctcactgcagcttctgcctcccaggttcaagtggtgtccctgcctcagcctccggagtagctggaactacaggcgcgtgccaccgtgcccggctaattttttgtattttagtagagatggggtttcaccatgttggtcaggatggactcgatctcctgacctcatgatctgcccgcttaggcctcctgggataaagtgctgggattacaggtgtgagccaccacacccagccccatatgctattcttaacaataaaaaggttttaaaaatttgtctttgggaggctgaggtgggtggatcacctgaggtcaggagttcgagaccagcctggccaacgtggtgaaatcccgtctatactaaaaatacaaaaaaaaaaaaaaaaaaaaaaaaaaaaactagtcgggcatggtggcgggcacctgtaatctcagctactcgggaggctgaggcagaagaatcacttgaacctgggaggcagaggttgcagtgaaccgagatcgcgccactgcacgctagcctgggcgacagagcaagactccttttcaaaaaacaaaacaaaattgggctgtgtgtggtggctcatgcctgtaatcccagcactttggaaggctgaagcaggaggattgcttaaggcaaggagttcaaggttacaatgagctatgagtgcacatcagtctgggagatagactgagactctgcttctaaaaaaaaggggggtaggggtgggaaacgccagctcttaaggtagtcattagaatggtgagaagaggttgggttttgttttgtttgagacggagttttgctcctgtcacctaggctagagtgcaatggtgtgatttcggctcattgcaacctcttcctcccgggttcaagcgattctcctgcctcagcctcctgagtagctggaattacaggcgcttgccaccatgcccagctaatttttgtatttttagtacagatgggctttcaccctgttggccaggctggtctcaaactgctgacctcaggtgatccacccgctttggcctcccaaagtgctgggattacaggcgtgagccaccgcacccagctgagaagaggctggttttgacatgcggaaagtgagcaaacggagaagatgaggcatgtatcaggtgaaaagcagtgctgaacactgtgagatagagaaacctttaagatacttaactatccaggccggaggcggtggctcacgtctgtaatcccagcactttgggaagccgaggtgggcggatcacctgaggtgggaagttcgagaccagcctgaccaacagggagaaaccccgtctctactaaaaatacaaaattagccgggcgtggtggcgcatgcctgtaacaccagctactcaggaggctgaggcaggagaatcgcctgaaccctagaggcggaggttgcagtgagccgatattgcaccactgcactccagcctgggcaacaagagcgaaactccgtctcaaaaaaaaaaaaaaaaaaaaagattgaactatccagggccactgtgtccactcagaccagtcacatcgcctgaatctagatcccttcttcacaaaacagggaggccagagtggtttaatggaaccagccctgcattttggtgttgagaactccgggcttaaaatcccagttttgttacttgttgatggctgtgtgaacctggacaatgacttcgcccctgcccctcgctccaacctgtttgctcatgtgcagatttaggtaataattcacagaattccatgataaaacagaagactaggcacttgggatgtttggtatcttggttatcaattaagagaatctgaacaatgaatgagaaaatactttgaaaacataaaagaatagataaaaggccgggcgcggtggctcacgcctgtaatcccagcactttggggggccgaggcgggcggatcatgaggtcaggagtttgagaccagcctggccaacatcgtgaaacaccgt[137 bp omitted]aatccagcccgggcgacagtgcgagatttcgtctcaaaaaaaaaaaagggtaataatcactacatggtttttaaactttagtgaaagcgcgggctagctggggggcatgagcatggaaaactggttatcccgtaggtcaagagcgaccacgtagtttactgcccaaagcagtacttttttttgagacaggagtctcactctgtcgcccaggctggagtgcagtggcgcgatctcgactcactgcaacctctgcctcccgggatcatgtgattctcctgcctcagcctcccgagtagctgggattacaggcgcgcgccaccaggcctggctcatgtttgtaattttagtagagacggggtttcgccgtgttggccaggctggtcttgaattcctgacctcaggtggtccacctgcgtcggcctcccaaagtgctgggattaccggggtgagccaccacgcccggcccaaagcagggcacttctgaaaaaggaggcaatattagtaattatgccagggcagcaggcataaatcaaagctggccccccacccttccagaactgagacaggacccaggagtctggtttcccatcaggcctcttatctgaacgagaagctctgcgagggcagaactgctgtgcctatatagagctggcttatttctggagggctcaaatctacttggagcaatgctcatgccactgtgagatgatcacggctaaccgattcagcacttaggaagcgccaggtattgcgctgaggacttcacatgcatcacctgagttaattctcaccaaacctttatgaggtaggcggatttattatcttccactgaggaaactaaaatttaaattggttaactccttcaaggccacacattttgggtggaggagcagggattgaaatcagatgaggatcatgaaccctcgttctcaattactactcatatcggtgcctccgtttttcttgagcgtccgcctgcctgcccccacgctggcgtgcagccaggaccatggacatctgagaggctactcagccggggtacctacagcccctggctccacacaagcgccggtctgacagcaggtggcaagcttttcctcttctcaagctagcactggaagggatgcttgctggggagaccggagatgggtggagctaccactcggacgcctgcaggctcctaccaaaaagaatcctgcagggagccggatgaggagcacctcacagctgccagttccctgccaggctacccgctgtagctggtttgagggctcagtgaggctttgaactgcaactaatggccacagatgtcaatgttggaaaggccctacaatgcatttagttgatttcccaactctgccgaaagccatctctattacttgcccccgaaggctagtttaagttgcttctactcaagagcatttacagcttgggttcgatgtatatgtagcccgggcatggggcagggcttcttaacatttggacaccacgcagcacaaaggcccagagagggaaagagactggctggaagaggcagagccgcgcgggtgccaggacccaggtccttgctacgtccggagcctacgtcaccacgatgcctcccctgggccggcggcagaacccgagacccccgcaggttctaagacagcccccacgccccccagtgcgcacgctcagtccaaccccgccgcgcaccgcccaccgcgaacatccggctcctgcgtgtgtgctcgagggggaaactgaggcggggacgtgccagtgaattcattccttcctcagtccacccgcaggcctacaaagctgtctccccttcctcagcgccacaaggaacagcagggacggatgggaagaaggggagggggccgaaagcaagctgggtgcgaggagccagccgaccctgccacactcaagatggcggcgcggccgcggcgaggtccctcagaggcggtaccagcgcatgcgcagcgcggagtcccggcccgggacacaagatggcggcagcggcgctggggagggcgaggcggaggcggcaaaacgggcggtcgagcagaacgtgtagccgcgtcccctccagtccgctccgggcaggtaagagtcccaggaagccatggtcccgcagcgagccgcgccagggtctggggatccgaagctggggggcggcggcccctccggcgctttctgctcgggactgccgcttgccctgtctctgttgccgccgccatcttagacccgcgggtgggcggccgcgccggtggccgaagtgagggaggtgggcccggagagccccagcggagcgggctctagggcccctccgctgctgccgccgccaccgcctttgtgtcgggctccgactctgagtcgcctcagcccgggggcgggagcgcgcggcggggcggggggcggagcccgagagatgggccggcgcgcgcgcgcgcgccaaacagcccaccctcgctggggtagggggaggggaaggtgcgcgcgcgcgcgcgcgctggagctcgcctctcgccttcgtgcgccgtcgcgcctgcgtactttgttcgccctttgactcctccctactgggccggagaattctgattggtacattgcggagatggtcccgccccacgtgcctccaatcccggactcggactctggcttctggtgggtttttctggttgcgcagatagagttgtttatccttgagcagcggtaattctcaaactgcggtatgcgtgggggtcgggaagccacaggataaataaagacgttaacttaagagcagttatgtcttactgggagcgtacaatgctggactctacatataacggtcgagtgattccggtttataagccggaaagcagaagggcccggaatccgggtctgtccaacccaggggctggtacttcggccacagacctgctgcgctcaagtcacataggaaattaaaaatggttttaattgcaaaaaatgggtacattttttcaaatagtgtgaaaaaatgagtcatcctgtctcccagtcactcttacggtgcgttttaaaaatacaaattcttgtgtgcctcacctccgtatttatttctggcttctgagatgcgcagtgaggcacaggagtctgattttttttttttttttacaaactccaagatgattctgatgcacagctggctttggaaatactgcagtgtccccatttagcctcacactaagctgtgccgcttgtgcgtattctgcaaagttcatctacccggtgcatcaatatcacaggatgtttcttggggaaaatatttttcaataaaggcgaacaagatgtgtcacataatgtgtttgcatgtttttgtttttgcaagacattattcagagcgtgtctttgacttgctgtgggaggcttgggattgtgcccccacagatcagtgataggtatgtttgttgatttttctctggtctaagggtactttattttattttttatttttatttatttattttgagacggagtcttgctctgtcgcctgggctggagtgcagtggcgcgatctcagctcactgcaacctccgccccctgggttcatgccattcttctgcctcagcctcccgagtagctgggactacaggctcccgccaccacgccgggctaatttttttttttttttttttttgtatttttagtagagacggggtttcactgtgttagctaggatggtcccgatctcctgacctcgtgatccgcccatctgggcctcccaaagtgctgggattacaggcgtgagccaccgcgcccggcctcttttattttttaagagatgaggtcttgccctgtcacccaggctggagcacagtggcatgatcatacttcactgcagcctcgaactcctgggctcaagtgacccttccacctcagcctcctgagtagctgggactgcaggtgcaatttttttttatttgggcccggcgcagtggctcacacctgtaatcccagcactttaggaggcccaggtgggtggatctcttgaggtcagaagttcgagaccagcctggccaacatggtgaaatcccgtctctactaaaagtacagaaaattagccagctgtgactcatgcctgtaatcccagctactgagaggctgacacaggagaatcgcttgaacccaggagttggaggttgcagtgagtcgagatcgtgcaatgcactccagcctgggtgatggagtctcactccgtctcaaaggaaaccaaaaccaaccaaacaaaaagctttatttgttgtagagctgggggctcactatgttgccgaggctggttttgaactcctagcccagctcccaagttgccaaagccacgtgcccagcctaagggtacttcagttggcaggactggctacagagtttgtggggcccagtgtgcaaaatgtaaatgtgagctccttgttaaaaagttattaaaaattttaagacagtgacggcagagccttacaccaagctcagggctttcctgaatgtggatccctgtgcagccgtgcaggtcacatgcccatgaaagcaaacctattggtgagaaagcttaagaggtatcattttcatcccctgtattccctcatcccctctcccggtgtgtcctgccctggaggcccccaacttgctctttgtttttgtccctcttgtccctgccctgcagcatcccacaggtctgtgactgttttcctatttgctttccagctgctgatgcaaggaatcccctgggctcccgtccactccactgctgaccagcccattcgcctgtgctgagtcttcctgcaggcctttccttgcctctgtgggaccctgtgggggtccatccggctggagaagaaaagcctctcatgctaacgttgcagaccccagagggtgagagaaagggggacttcattcagtcttgaaacctgtgtgctcagcccccaaggcatcaggaattcttcctgcccagagaatcaaggcagcttcatttttttcgtaccttggtcagtggttctcaacctttttgttatcaaggcactttttgttgtacatatgtcctgttgccccctgcatttttatctgccaaactgtactgatggagtaaccattgacttttcccttcctaaattaaggaagacgtctatgatggagtgtacaataaaatcagtgtcccaatgattcgtatgatgtcatcaacaaccaatcagagcttctgatcagcatgagataatcagtgtgaccacaatgagttgataaaatttcagcatgaaaagataactgatgtttaagcctgcctttgtggtcttgttgtgggcaaaagtttgatttcttttgggtggtgtgacctactgaaaacaactttagcatcaccagttctatctcagttagctcccagttgtctgacagccccaggccagaagcactttggctcctgaggctgttgctgggtgtgctttgggtgggggagtagggaatacagatctgaaggaactggcctccttgctggtacttacagtaaatattcacctggggattatgaaggagtcaattagatagtccttcttggttgcattggttattttagcaatagctgcttcctgccatgtagtgtaaaataaggtgaccaattagattccatgcccttccctagtgtgctttgttccttttagattttactggatgagagcagtaaaatcccatctccttctgggagttgttactattccttcttgtaggaatcgcttctcaagggcagaccctgttctgtcttttttgctgctcttggtgctttgtaaatatttgcagaatcagtagtgctcctgttgggtccaggtcctaggcctgagcacaggagagagctgaattggacgcagttcctatttctggaagttctgacagtttagtggggagacaaacccagctgatagatgagaccatctgagtgctacgacagaggtgttcacggccctgaggaggagctctgaccacctggcctggggaggggagagtcaaggaaggcttcctggaggatgtgaacccagtagcaagccaggcagagaagagggggaggggcatttcaggcagaggaagcagcaggagtgcacccattgaacagctggaattgcagcttagatcccagggctgctgtgtggcaccatgctggccctccaggataggacctgattggatttctccacatcggtgggtggtcactggggccctgggtggattgtaattggcgggtgagggggtggagctgacactctttggtcctctgtgtggcaggtcctgtgtgggtgtggagatggccaatgagaatcacggcagcccccgggaggaagcgtccctgctgagtcactccccaggtacctccaatcagagccagccctgttctccaaagccaatccgcctggttcaggacctcccaggtactgagggggagcagtagtggggtggtggggtaggaagggcaccctgggagcagtcctgaccctggctgggctccgtgcctgtttgcagaggagctggtgcatgcaggctgggagaagtgctggagccggagggagaatcgtccctactacttcaaccgattcaccaaccagtccctgtgggagatgcccgtgctggggcagcacgatgtgattgtgagtgccagcctagggtgggggggtctcagagtggcctctggcacctgggccttccccaaatgtaccctgagcagccgttcagtgcccagccctgtgctggcacctgcagatacaatgacaagcaagacagacacagcccctgccctcatggaacctacactcaaatggggtagactgacaagtaaacagatgattgcatggctgctgcacggtgggtgctgtgccgcgaggcaggaatgaacaaggcagacttgctccctacggtcgcagagcacccatgggctgccaggtgacagcaggattacacttgtggtccgtgtatgaggaatagtgttagaatacatctagatcctgacatactctggggaaggcaaggagatgggaaaagctctgagaatgagtgtttaaggtgagagagtgagtgagtgtggggaggaaaagaacattctaggatctgacatgtcagtacgacgggaagtacaggcatgggctgtctggtgggaacatgggcttttgggtccttctcagctggggcagcatttctttactgggcacagttgagacagttggcatcttcattttgcatgtgaagacactgaggttcaaagatggggaacgactggcacgagacctcacagtaataggcagagcaggacgcacacctgatgtgagttcagggccacactactcaccaccatgcattctctcagtgttaccaagagtcccatctgcagggccttgctttttacaacaataagcagtttttgagcttttcatttattcctcacattcattctgttcttgaggaaaataatgtgtaatgagtactgatctcatgccagatgccatgttaagcaggtcatattcactgactcatttaataatctcagtggtgatgtagggattagcatggccattctgaaggtgagagaactggaagggaagtaacacaccctgtcgcacagttgcaagttgcaggcaggactggagcccagtgttctctgcctgtatcccagctcctctgctcttccctaaggagtaggagcaggggtgggagggcgtgaggattcaaagtcctgtggctcctaagccgctggccctggttgcaactctgctggtctccctccaccagtcggaccctttggggctgaatgcgaccccactgccccaagactcaagcttggtggaaactcccccggctgagaacaagcccagaaagcggcagctctcggaagagcagccaagcggcaatggtgtgaagaagcccaaggtgagtgtctgtggccaggagccggctgccgagcggccggctcagacgggccgcctgcaggctccctgcaggggctgggcattggcaggccagccaggaggggggcctgggacacagttcaccaggtgtgcactgtattggatggagcctctctggtgaatctcctgacttgacacctttgtgactttcactacagattgaaatcccagtgacacccacaggccagtcggtgcccagctcccccagtatcccaggaaccccaacgctgaagatgtggggtacgtcccctgaagataaacagcaggcagctctcctacgacccactgagtgagtccctgctgattggcttgggggcacccattgctaatgtcagcctgtctgggactgtggggtggtgtgggtgggcaggacatcctcatcactcctctctgtgccccaagggtctactgggacctggacatccagaccaatgctgtcatcaagcaccgggggccttcagaggtgctgcccccgcatcccgaagtggaactgctccgctctcagctcatcctgaagcttcggcagcactatcgggagctgtgccagcagcgagagggtacctgcctctgggctgcagcctcctttatttccacccacctttagcatgagccaggtttggccaggccagtttggggatggcggagtggggcccagtggtgagccatgatcacaccagtgcactccagcctgagtgacagagcaagaccctctttcaaaaaaacaagagtatctataccttaggattctatgataaccattaagtaaaatgaataagtattaaatgaactgtagtttttaattttatttatttattttttttgagatggagtcttgttctgtagcccctgctggagtgcagtggcaccatctccgctcactgcatcatcctcctcctgggtcccggttcaggcaattctcctgcctcagcctcccgagtagcgggattacaggtgtacaccaccatgcccagctcatttttgtatttttaatagagatgggggtgtcacgatgttggccaggctggtcctgaactcctgaccttgtgatgcgcccgcctcagcctcccacagtgctgggattacaggcatgagccaccacacctggctaatttttttttaagagacaggatctggctatgttgcccaggctggtcttgtactcctgggctcaagccttctgcttgccttggcctcccacagtgctgggattacagatgtgagccaccatgcctggcctagtttttaatttttatgattagtaataaacctatttaaccttgctcaaatatagaatcctctggcctttcacctttttttttttttttttaatttttttttttcttgagacggcgtctcgctctgtcgcccaggctggagtgcaatggcgtgatctcggctcactgcaacctccacctcccgggttcaagcgattcttctgcctcagcctcctgagtagctgggactacaggtgcctgccaccacgcccagctaatttttatacttttaatagagatggggtttcaccatgttggccaggatggtctcgatctcttgaccttgtgatccacccgccttggcctcccaaagtgctgggattacaggcgtgagctaccgcacccggcccaccctttttttttttttttttacattatgtaatacttttttttttttttctttttctaagatggagttttgttcttgttgccctggctggagtgcaatggcacggtctcggctcactgcaacctctgcctcccaggttcaagcgattctcctgcctcagcctccttagtagctgggaatatgggcacatgccaccacacccagctaatttttgtatttttagtagagatgggttttttccatgttggcaaggctggtctctaactcctgacctcaggtgatccacccatctcggcctcctgaagtgctgggattacaggcgtgagccactgcgcccagcctttttattcttttcttttgaaacaaggtctcgctctgtcacccaggttggggtgcagtggcacgaccacagctcacagcagcttcagccacccgggttcaagcgatcctcccgcctcagcctcccgaggagctgggacacccagctaatttctttttttttttttttttttttttttttgtagagacaggctgttactgtgttgcccaggccggtcttgaactcatgggctcaagctgtccttccaccttagccttccaaagtgctgagattacagatgtgagccactacgcctggctagatacttatcaacactataaaactagtgattcttagaatatattttgggaaatgcagcctagaagcttctgaagtgggactgtgtcttgcttactgctgaatgcgatgcttcctatacgtgccaagctccaagtgggactgcttgattaaatccaggccttcagcagctctcctgtcctgcaggcattgagcctccacgggagtctttcaaccgctggatgctggagcgcaaggtggtagacaaaggatctgaccccctgttgcccagcaactgtgaaccagtcgtgtcaccttccatgtttcgtgaaatcatgaacgacattcctatcaggtacagctccacagctggggatgaccctgggccatttggtttctgtgcccagtcatgtatagaaggcctctaactctgcccactctgaaacgcaggttatcccgaatcaagttccgggaggaagccaagcgcctgctctttaaatatgcggaggccgccaggcggctcatcgagtccaggtttgcctgtcttctgccccaggcgagatgggtctgtgattaaagtggcaggtcataggccatcttgcccagtctcatgcagggctgtcattgctctcggtggcagaagtggggccagctcccaaaggcagaacaagggctgtgatggaagctaggggttgatacccagcgagcccatggaattgggatgaggagggtggagccaagccattcctttcttctgccctccccttgactggcaggagtgcatcccctgacagtaggaaggtggtcaaatggaatgtggaagacacctttagctggcttcggaaggaccactcagcctccaaggaggactacatggtgagtgggtccccgggtgagaaggccagttttagggctctgtggccacttcctccaggaagcctactctgcctgtccaggctgggcaaggcctcccccagcggcctattcttgtgcagtatggcagacgttcgacattcgtcagtccccaaactcatgactgtggagatgtttctctgggctcctggctttctcccacagaacatttccattaacaatcttaatggagtcttatgcttggccacacaccacagatagctgcctttcagcctaatgaatgttcagcatctcccttgtagatttttggaaacagattgacagcctgctttttttgggtgtgtgtgttcatatcatggttaagagctaccatcagattcaattccctactcttaatgtgtccaaaacagttctgttttctggccaaaacctatcacttcttaaacctctccaccagcactagcaatgggctttcttttcaggaccatatttcacaagagacaaggtttcgcacttcacgatagtaactgtgtacttgacacgtagagagtgacaaaggtaggtgtactcactagccagagtgactcattctcactcttcagttttacacgtgtgattcagcaaaattacaaatcccgacagtcatctttgcaagtagctaaaagctcaaatctcaagtctgcagcaaccaagcaccctgttttgtaattgtgtctttccccaatagactgcaaacaccataagctgggactgtgctggtttgtctgtttctccggtaattatcatgggatctagcagtgtaaccccaacaaaagctactggcatttattgtacacttactgtatgccaggcatttggcaagcccttaagggaaatgatcacatttaatattcaaactgccctgttaggtatctcgtgtccccttgacacttgaggaataagattgagagaagccaggggatttgtccaagtgacacagctagtcagcagcagagctggtttcaaaacaaggactgctggactccaacagccctgcggttacctgccagcccagctgagcccctctggcctccactagcgccctgatccagaatgtgtcctctaggatcgcctggagcatctgcggaggcagtgtggcccccacgtctcggccgcagccaaggactccgtggaaggcatctgcagtaagatctaccacatctccctggagtacgtcaaacggatccgagagaagcaccttgccatcctcaaggaaaacaacatctcaggtaggggaaaggtgaaggaggagccagctgtgatgccgtcagctctataccctgatggaagggacaagtgagactgagcctcaaggccagggactggtttggggcagaacctgcctgtgtcctttggctgtacttctctgggaaacggagaagtgataaagggagagccagatggtggtggtgaagataagctgggagtcgtagttaggtgtacctgaatttacatccattctctgcaagccttactttccccagactgaagtgtagcacctggtggtaggattgtgtgagtactcataggtaactcaagtaaaccatgtggccccaaaagatccccaaataaaggatcgtcgctattacgatgacggcgatgcagttctcgttcttctgcctggcagcacaacccacgggcctgagccttcttgcctgacagcccaaggcacggcatacggggccctgcttcggtactgagtgtgttgacacaggccaccagtttctgccccggccagttgcctggctggtttctttttatggcttttcattccctttctactgaactgggccagagtatactgatctgtggaatgggacttccctctctcggtacaaagcatgtggcccacagtggctgcagcgtgagaatgaggagtgtggtccctcactgctctccctgcccacagaggaggtggaggcccctgaggtggagccccgcctagtgtactgctacccagtccggctggctgtgtctgcaccgcccatgcccagcgtggagatgcacatggagaacaacgtggtctgcatccggtataagggagagatggtcaaggtcagccgcaactacttcagcaagctggtaagagctgcggggaggaaggccctagctgatggcatgagtcagggcctaggatctttcctgagcagagtccccagcaggaggccagtgatgaggacatgagggagcactgctgaaggctcctcctctctgtcccgctccacagtggctcctttaccgctacagctgcattgatgactctgcctttgagaggttcctgccccgggtctggtgtcttctccgacggtaccaggtacaggcctggggcagcagggagggctccccaggagggaacagggagggtgagccccaggtgctgacggtggccactccgcagatgatgttcggcgtgggcctctacgaggggactggcctgcagggatcgctgcctgtgcatgtctttgaggccctccaccgactctttggcgtcagcttcgagtgcttcgcctcacccctcaactgctacttccgccagtactgttctgccttccccgacacagacggctactttggctcccgcgggtgagggccaagggctgcccctctacccaggccagggaagaggtcctccagagcacagggcccgcctctgctggctgtagtgtcaggcaggcttgggtggagtccctgcctccacctcttaccggctatgtgaccttggacatgttgcttaacttctgggagcctgagcttttctggttctgtgggcaggcacgtgacacccctaagctggcctgtgggtttctcagtgagtcagttcagggtggaataggaacacgtggtcccaggccctgagaggagtgagaagtggggccacagacctcagaggccttacaaactaggggttgaggtgaccacagatgagagaaggtaatgctgtctccagaaggaagaatggtcaggacctccagaggtccagagctcagcagctggggatcctgggtgtagcttctgctgtggtggtggtgggctcagaactggatttgaattccagcttggtgaacatgggcatcccagcctgagcctcactcactgtcctcattcattcagtggagacggtcatgccttgtgccccaatgaattagggtgaatgctggcttctggacaggccatctcttcagtgtggctgcctagggttggggggtggcacctgtttctggttgagggactgggtcctgatgggacttagaatgctcactcctgtccccaggccctgcctagactttgctccactgagtggttcatttgaggccaaccctcccttctgcgaggagctcatggatgccatggtctctcactttgaggtgggtgcactgccagggtgagaggtgggcaacaggcaggattgccagccacctgggaggtagtccctgacatccaccctgtgtccccttccacagagactgcttgagagctcaccggagcccctgtccttcatcgtgttcatccctgagtggcgggaacccccaacaccagcgctcacccgcatggagcagagccgcttcaaacgccaccagttgatcctgcctgcctttgagcatgagtaccgcagtggctcccagcacatctgcaagaagtgggtgccagggagggcaggggaaggaggctgggctggccaggccaggcccagccccaccctgagccattgcctttgcccgcagggaggaaatgcactacaaggccgtccacaacacggctgtgctcttcctacagaacgaccctggctttgccaagtgggcgccgacgcctgaacggctgcaggagctgagtgctgcctaccggcagtcaggccgcagccacagctctggttcttcctcatcgtcctcctcggaggccaaggaccgggactcgggccgtgagcagggtcctagccgcgagcctcaccccacttaacatatcctgcggggaggaggagccccaggggtgctagtctggactgctgggactcgggcccctggggcctcagagggaccccggctgccactgacatatgaagattatggttctgccagggctcccctccctgcctgtccccaagtcctcacctcaaactccctccaagtcccatgtatataggtcctgatgccttcccaaccccgcccctcaccctgttgccaccttgtttcatttgtaaaaggaaatacagaaacccccccaagaatgtgtgagggtcttgagggcagagaaggctgaggcagctggagctacttctgggaccacactcccctccctccctccagcagctccttctcatggcccctgggccttcactctcccatctggggtcccacacagctgggtccctggtggcctctgcctgggctcaggaggtccgaagagtccaaggccctgcatcccctatctccaaactcccccagcagggcctgtatggatacccctggggatcagaggactgggagctgtgcctgtccccaacccaaaagccagactcttgctggccctggatccccacagtgagcgaagagctgggtgtgcctcacagtcaaggctcaggagagcagcttcagaggatctgtaggcacagagcgtgtgctccctagggcccagggaggaagcaggtctgaaggtgcttgctggggctctcgctggttcagccgtctctgaaccagccacctctctcattgccaggcctctgcagcaagggtctgccctgctggtggatcaccggacttaacaggggcagggcaggacagggcacgctgtggagccaggcagcctccacctcacaagacctggcctggtacaggctacagcagcaagcagacaaagtaagctgttcaggactggactccggtccctttattgagactgacaggccagtgggtccacccaaacaaaaataaatttctctcccaaagcctgcctgcaggctggggcacccagcatgtcctggctggggcccatggctgcccctaaccccaacagcacaggtctggctccctgggaatgagaggatgctggctatccagtatctggagatcctaaatgaagagggaggtgagtcctggtggccccctacccccaggagagctggccgcaaatccatgatctgtgttgggccctcggggctcagtcatcggccagggtgatgacgtcgtactcgatgccctggtgctgcagctgttgaatgtgttcgggcactgtctcgtctgtaccaaacaggccctgggcttgggccatggcagcatcagccactgctgccaggggaggggaaagtatggtgagctggaggctcaagagctgggtccatacccagccccatgctcctcaggatccagctccatacctgtgacagctgagtgtgctgcagcctcaagttgagcctgtgtgacaagctgctggcctggggacacaggcacatactggatctggaggggagaagctgataagatgctggcctggagaaacctgcctgtgccccaggtctccctgtccccccacggccctacctgggactcctgaaggaacggggctccttgttcatactggatgtgtgtgatctggccctcctgtacctgcagagaggaagccaagctgtgatcctagggagaggtcatgcagcccttcaccacacagcaccctcatcccaggtctggcctacctggatgtgatggccttcagggaccacaacatattcctgggggagcaggtgctggacaccatcctgggagatgatatactgcacctgttggtggggggggcgggcatggcgaggcaggtgctgaggccccactcgccaggagcttagctaagaaggcagagtggaagactaggaacagccaccagcaacaatgcagttgttggcaagcatggaccccaggaggggtggtttggaaagtatcattcctccccaaggtaggtctttgggagggtaggaggtcacagctgaggggattaacagtagctagtagctcacctggttgtcggaggtcaccaggtgctgtacggtctggccatctgccgtggtgatctcttggatgtaggcggcttcctcctgccaggaccaagacagctctagcctcatttctctaccccaacccctgcctgtcgctggccagagggcccccagtcctgactcttacctgattggtcactgtctgttcctgggcaacgatgatgtgttcctggctcagtgcctgctgtagccgctctgggcccaggaccccgtgactggactggagtgcagctgggcagagaggagaggatgctcacctggggtccaggaaaacctgcaatgccccagctgctactgtacccagtggtgccttttggggcagtggcccaagtctctggatctaccctgttgcccaccctgtggccccaggggcagctcactgtgcagggtggccagtgtttcgtcatcactgttcaggatgatggtctgggttggggtctgggtaggggcccgggctgtaggggttcctgacttcctcccatcaggactgtgcagccgctggatgtggaacttgaggtgcccgttacggttgaaactgagggggatgaaaggtggctcaggttagctccaccatacatgcccagcagtccccacccaccagtatctggcctcaccgctgcccgcagaggtggcatgcaaaaggcttctcctttgtgtgagtcagcatgtgccgacgcaggtccttcttgttcttggaggcaaagctgcactggctacactggtggggccgtaggcttgagtgctgtgccatgtgcgcctgcagagagggcagagttgggggcattggctgggtcaggacagatggcaacaaatccccggatccctgctgacagctggtcagggaaccagacaaagtggacctgggaaaaccaaaatcctgtgcactaacaagaagctgggtagaaaggccaagccggatccgtatctggtgctgctgtgtcctaagaatgaaaggccatagattccatcattattaggtaaattggaaaatctcactttacccatatgtaacacaggtgttagatgaggggacctgtgcaggtcccatcgggccctgaattttttttttttgagacagttttgctcttgttgcccagaggctggagtgcaatggcgtgatctcggctcactgcaacctccacctcctgggttcaagcgattctcccgcctcagcctcccaagttgcagggattactggcatgcgccaccacacctggctaattttgtatttttagtagagatgggttttctccatgttggtcaggctggtctcaaactcccgacctcaggtgatccgcctgcctcggcctcccaaagtgctgggataagaggtgtgagccaccgtgcccggccctggccctgattttctagggctgaggcctgatagggcgttcacctctgcactgtagggtggggctctaggccctgcttccctctccaacctctggagaggatgcagtgcatgactggatctgaaaacaaaatcctcaggcaaacagggaggccccaagctgggctgtgaacctgccccagaactggcccactcaccttctccatggtggctccccaaccacctcgaacctctgtgccctcagtattctagaccagtggtccccaccctttttggcaccagggactggttttatgggagataactgtttcacggcatgtgcagggtgatagttttgggatgaagttgttgcacctcagttcatcagatattagttagattcttagaaggagtgtgtgacctagattactcgtatgcacagttcacaatggggctgtgctcctgagactaatgcagctgctgtgacaggaagtggagctcaggcagtagtgcttgcccacctgccgctcacctgctgtgtggcctggttcctaacaggccatggatgactaccagtctatggcccaggggttgggcacccctgttctagacgttcgagtctccctagccatgcctctgtcacacacttctgtgcctttgctcctagaggcccagcttggccatcccttctgtggcattttccccagcacacacaagttcaaatgacctgctctgtgtcctgcacccttggttcacactcgggacactgtgtctggcattagtcacgttgtgtgtggtttgcctccccaccagaccaactccctgagagctgggaccttgcggagtcatctctgacccatctcatccactcagaggagagcagaggatctggcttgaaagggcactcattaaaggtttgttatacaaacgagtagcccaatgaatgacagcagagacacaggagcaaccagcacctacccggacctcgggccactggcgggcactgaaggggcagtcggggcacttgaaggcaccaggcccagcgtgggcccgcttgtgactctccatctcagctcggccagggaaggcctcggcacagatcttgcaggaaaacttctttgatgcagcagtggctgcagatggcggtgacgggggcactgccaggcccagggctttgctggttgcaggaggtgaggaggcagagctctgggagtcccctacgcagtgggtcttggctggagatgggggctcagggccgtctctgggcagtcccccacactgcagcaggggccatttggcaccagaggccagagcatctggacttgggaaggagatggagccatctgcggtgagctgtagagagacagggagcatgaggtactgagaaggggagggaggtgggggagtggttggcatccccaagcctcacctcaatgtggtgcaactgggtaccatcagtagccatgatgtagtgggtgccagcttcttttagggtgtcactcacaaccacagcctgggctgcctctcctgcgggctcctcgctgtgggcatggagaaggttctaggagaagatggagggccacaggagcccccttccccaagcaacaggcatcaactgaggagtgactgtcaccacagatggactcaagtcagaagggcccagggttcaactgtggctctgccctgttaccaaatgaccctctaccatgtctcttgtaaatgattacaactcaagcatgggtccttctcaaaagctggtaattcttgtcctcggcaaacatggcgaggtggggggcacacagtgaggcagaggggtctaacccaaccagtagcaaacggtgaatccaccaccaggagctagtggaggaggcagggctaacgaggacctgctgcctaagagcagacagcaaatgctgagactggccgcccaggtgctggccaagggcatgggcctggggatcctgactccctgctcagctcaacaatttggcacttggattcagggcttcctcagatggcctaagagtttggtgaacataaacatgcctgcccaagctcattcactgtagggaagccaagtacaggtgccaggcctcaatgctggtaaagaggcctgagcttgctcggagtgtcagaactgaagaacacctgggatcacccaagaagagcacttgggcatgggaaccaaagggaccagggttcaaatctcacctactgcatgtgtggtttcaggctggtcacttaacctccctggcccatttcctcatttgtaaaacaagggaaatctgggtctcatgggaatggcttaggtcccatcatgagtgccaagtgcttggaatatctaagtggctaaaaaatggtagctcttgacctcctgagaagggtagactccaccactaatcacttgatgtgtattgggatttttgcctcctgccaactaggcttgggtggggcccaaatcggaccgaccgaccacacctacaaaaagctgaaaggggccttgcaggcagcaggtctcacctgtaaggtgtgccaggagctgatgttccctcctccatagggggtgctgtgatgacactgtagccagtcccaccaaatggaccaggtgccagggtgatctgcggtaggtcaggagggcctagctggctctcggctgctgcaccgccccctggctctgccacgtggagggtgaccacctgtggagtggcaccttcaggggagggctgcccaccaggggatgctaaccctgcttccacatcttccgacttcaccacagccacctgcaacggcaccagggggcgggatgggaggcactggtggcagaggagcgggtatgcaagacgcctcccccatctcagtgtcccagatgcacccacacactctagtcagaccagtgctgccaccactcatttgaatagcccaagttctttctaaaatatactctggctttccaaatcccactcagcaactggaaatagaccaacaggaatagggcagagcagttgtgccccccacaaagatttggcaacgtctggagacatttcttatcacagcaggagggggatggtactggcatatagtcgggagaggccagggatgccgctgaacaccccataatgcacaggaccgccccaccacacaatagtatctgcctcaacatgctaacagcgctgcagacaagaaatactggggacaactgacaaatcacttagaaaaaagctccagtgtacatcttattccagttggcttcaaatggtttaaagattaaaatgtaataaaactctaaatatattaaaataaaacgtaggtaagtattttagaattgggacagggagatttttctaatcatgacagagaaagataaaacctagagcaaaattaaccataaaatgaagccaaaaaacaaagaaattggggttgggggatatttcacaactcataaaaagtggacttccctcatatatggagctcctgcaaagcaataactaaaagctaacaatagaaaaacaaatacaggacacaaacaggtactttagaaaggaataaaatggtctctgaacatacagagaggagttcaacctcatttacggtcatacaattactttttttttttttttttttttttgagactgggtattgctcaggctggagtgcagtggtacgattacagctcactgcagcctcaacctcctgggctcaagcgatcctcccacctcagcctctcaagtagctggtactacaggcatgcattgccacacccggctaattttttaagagacagggtttcaccatgttgtccaggctggtctcaaactcctggactcaagcaattctcctgccttggcctcccaaagtgctgggattacaagtgtgagattggtaaagatttataacgactgaggccgggcgtggtggctcacgcctgtaattccagcactctggaaggccgaggcgggcagatcatgaggtcaggaaatcgagaccatcctgcttaacatggtgaaaccccatctctactaaaaataaaaaaataaaagaagccagtcgtggtggtgggtgtctgtagtcccagctacttgggaggctgaggcagaatggtgtgaacccgggaggcggaggttgcagtgagccgagatcgcaccactgcactccagcttgggcaacagagcaagactctgtctcaaaaaaaaaaaaaaaaaaaagatttataaagactgataatacccagtgtattggcatgaatgcagggaaatataccctactggtggccacgtatactggcgtatctttttacaaggcttctcaccataccctctgacccactaattcttcttgtaggaggctttttaaaaacactacaaagatgttggctgggtacggtggctcacacctgtaatcctggcactttgggaggccaaggcaggcagatcacttgaggtcaggagttcgaaactagcctggccaatatggtgaaaccctatccctactaaaaatacaaaaaagtagccaggtgtggtgacgtgcacctgtaatcccagcaactcaggaggccgaggtaggacaatcatttgaacccaggaggcggaggttgcagggagccaacatcacgccactgcactccagcctgggtgacaaaatgagactccatctcaaaaaaaaaaaaaatttatgagcactgaaaatatatgtacagtgaagcactgcttgaattaatataaaacgaaagaacccagccaataaaggactgcctaactatagctgagaacatccatgtgatcaaatgatacagagatgcaagatggagatcttaggagaataagggtaactgcaggtgctggccaggccgtgcatcacatgctgttaggtaaaagatgacgctgaggagcagccaataatgtgatcccattttttaaggaacaaaggtctaggtgttggtatgaacatgaacaaatccctgaagaaattcttctgaacccatttactgggtatctgatgggaggggagaaatgccaaggactttcaccttctactgaaacatttcctaatgttcatttttttctttttttctttttttttttttagatggagttttgctcgttggccaggctggagtgcaatggcgcaatctcggctcaccgtaacctccgcctcctgggttcaagcgattctcctgcctcggcctcccgagtggctgggattacagacgtgtgccaccacgcccagctaattttgtatttttagtagcaatggggtttctccatgttggtcaggctggtctcgaactcctgacctcaggtgatccagccaccttggcgtcccaaagtgctgggattacaggcataagccaccacgccaggcccattttgtttcttttacaagcatgtgcttttgtaagcagaaaaactctaccacatgagattggcatgggaacaggagacaaatcaatagaacagaactcaagtctagaaacagactcctacatatttgggaatctagtatatgaggaggacacttcaaaccacaggtgaagataccacgtcggatgacttctggaaaaaaaaaaatcgatccctacctttctgcatacaccagaaataaattccaggtggagtaagatttaagtgtaaaaaataaaaccctaagaaaaaaatataaatgaatgttttataaccttgggatacaagttgggggagtctttctagggatgataccaaagggaaaactataaaagactgataaattttcctatctaaaaatgtaaaacttctatacacccctaactgccatgaactaaattattatgatttctggaattcatcatcttaaaaacacactctccatcttctcatgaggctgggaaacaggaggggctaataaacttccctctgccttggagaccaggccagatgtgaacggggagggcagggaggggcaaaggtgttgaactttggggaggtgcatgaaccaagacccctggaacgcgagagagtggtctgatctagaggaagccctggggtctgcaggctgtaggaggtgtcccggaatgagggcgctcttgtggatggaaaagctagttcaagctgtgggggcacccacaggcacatggtggttgcagaggtgggaggaagacaaaacaagaacagggccccagatgccgcaggggcagtgtgtactgctccacctggcagaggtcaccagtgattctggagaatggacgggataccctgcggcctccgtggcaaagcctgttcctctctgtttgcccaccagacttcagcagatctgtctcctccactgcctgggagctcccaagggcggagaagctctgatacactgttttcctctagtcccagtgtccagtgcagggctgggtacctgcggtagctgggaaggggagcaggttcccaggcagctcacctgcagggctgtgccccccagttcccgctgagcactcatgttcagcagaagatccaaggctgtctgcgtggccatcgctgtcgactcctcagctcctgggtggggtgggacctaagcctgacaaagtgctagaaaactggcacccaataccaccccctccccatcttccagcccccaccagcacgacctgcccctgcccaactcagaggtcctaccctccatgagctcctatcctcctacagagctcaccttgctggtagatgatggtggcgccgcccagggtgtcagaacagagcaatgagggagcctcagatgactggaaagttgtcgcctctgggggtatctatggggtggagatatggccacgcctgagaggggccagcccagattcaagtgccatttgccaagcacctctgatctgccagatgttttacatctgttggcttgtttcatcttcataaccacttttctttttttttttttgagatggagtctctctgtcatgcaggctggagtacaatggctcaatctaggctcactacaacctctgcccctgggttcaagtgattcttgtgtctcagcctcctgaatagctgggattacaagtggccgccaccacacccagctaatttttatatttttagtagagatggggtttctccatgttggtcggctggtttcaaactcctgacttcaagtgatccacccacctcggcctcccaaagtgctgggattacaggcatgggccaccatgcccagcccataaccagttttcaaaatatacgagctcagtgctacagatgaacccactaaggctcagagaggtgaagtggctggccaagaatcccactcctaatacatagtagggtgagggcttgaacccatgactgtgtgattccagggcctgtgatctaccagcaagtcatgtggtccatctttccagggatagtgtgtcagctcacgtggcagagactgctagctacctatcctgaggccatcctcctcttccctcttgctaacagaactctgattttcaccagggtggcaatgtacccagctccaagacatttctcagcctcccttgcagctaggtaaagtgtggccacatgactaagcaacgatcttcaggtgaagttcatgaggaatgatggatagatggtaggtatcctttttgcctctcccccatcccttcctcctgcttcctgcctgggatgtggctgggaaggctggtgctcctgcagctatactggaccatgaggcaactacaaagatgaaagtcatatgcctgggatgactgggcaaagatactgagaacttattcccttacgactgtataatcaccgcaccagccctagactgccgacctgtggaattcttgtataagagagaataaaaactatgatcacagttaagttactggtgtttccattctctattaccagcactagaaagccacccttactctaagcttagggctggcatatgtgtgactcagtgagtttttaccacagtctcaagaggcagggattattttgttgcatctcaatgtgcaaatgatgctggggctgggagaagcggcctcactctgtcatcctgacccatgccccgaccttacctcaggaggtcctggggaactgggaggtggtccaggggccgcactgtgctgctgcttcagctcctcaatctgctgcagagagaagaaggggcgacggcgggaggggggctcctcagggtggcgcctcccccattcctcgaagctgcttgcgtgtcggcaccgtacgtgcaggcgcaggttcttcttgtgccgtgtgctgaagtggcagtactcacaggcgaagggcttggcccctggaggcacatgttggggcatgcttaagtctgcccgtccctagcctaccccctccaggaatcctttcttgaccctaaggatctctccaactgactgacttccagcgattcattcccgtatgtaggcaaacacatgccactgtccattctggtggcccaggacagaaatgaatcagggccgccctctgcactcaagagccttcctgtgcctacctatttgcaaagtcatgtgactacaagctcctgtgggtcatcacaggactctggctaagggaacccctggctccttttctgtaatcgcccctagtgtgctgaccagggagctaggcaccaaagaaacaatgtttgcagtgcagcttctgtgggccaagccaatggcgttgcttctgcagcttcatctgccaaggcagggtctggaagagcctcctctccagccccagtgccagcacacacaaggctcaaggaacaaatggaacttactttcatcatagccatatggcaggcactctgattcccccatttcataaatatggaaggctcggagagggcaagcgaccggcccagagccatccagagaacaaccagccaagcaggaacccaggctcaggttagggtgaatacgcctatgggaaattctctttacacttgaaggacttgggctgttctgtggctggggctaccgagggggaaggaagaggatgggagctaagcctctgatcaggggtacagggcactgagggctggtgagtggggctggggtgtgtccagcctgacctgtgtgcttgacagccacatgggacagcaagaagtcctctcggaaggtgcggtagggacaaaagctgcatttgaagggcttgtcactgacgtgggacaactggtggttcagcagtgccttcttgtcttcacaaacaaactcacagaactcacacttgaacctggaggcggttagagggagggaagctcagtaatgagctggggactgctcccgtccccaggggcctccaaggggatgtacctgcggttggcaacagcctggatgtgcgtgagcaggtgcattttgaaggtgtagcgcttcttaaaggactttccacactgtgaggggtggagagcagtgagatggcgatcaccctccatcacccaggggaggccctcctctcagccccagccctggctcccacccaccttgtcacacatgtggggcttctcagtgctgtgcgtcttcatgtgctgcgtgagtcttttctgcatggggtacacacggccacacacagggcaggggaaagagctcagctttggagtctaggaaggcataagaaggggccagatggagaaagaagtggaggagggaggataaaacctcccctcttgtcctcacccccataaacaacccccgggcaggttcccttcccaggccagcacgccagactcaccggatctggcctcttcttcctgtggggaaaaggccgaggaattagaccagagcttccccaagcccactctagaccctctcacactgaacagacccagcctcagctatgagcctactccctgccaaggcccctttctcttagaatagtgcttccccagctggagttcactggggaaaacgctaaggggcacgctgtaaataacatattctgcactcaaatatatttgtgaaatggtacattctttctgtctgtcaatcacaaaatgttacttgcatattaaaagctctaaggatcagttaaggcccggagtttgagaccagcctgggcaacataacaagacatcgtctctacaaaaaaaaattagtaaataataaaaagttagccgggtgtgctggttagcacctgtagtcccagctactcggaaggctgaagcagaaagatcgcttaagcctgggaggttgaggctgcagtgagctgtaattgtgccactctattccagactgggtgacagagtgagaccctgtcaatcagtcaataaaagctctaagaaatcctgcaggaaagaggtgttgaacagctctgcaagctggtgaacctacactaatcttacttagccacagaaccttttttttttttttttttcatttaaaaaaaagaaaccttaaagtatcttgggctggcttttccacacacacagctggagctactgtcccaggggatctgtctccaacctctgctcacacaccacctctcatgaagcgaactccttcctgaagctcgggatcgaattataatcctgtgagcaatcattaggtgcataagaacttgtgtttctctgtctcaggtgcactctcagccctgtgagagatgagtaggatctggagtccagaagatcttggatcatttactgaactcctttaggtacacaatttccttcaatcccttcaacaactgtccccgtttgatgagaaactaaagctcacaagaggtaagaggctgagctggggacctcaaggcctggtactgtcctgttctaagccaaatgaactggggtgaactgcctttctgctcatgcctgtagtgtgcagcaaatggggctggctcagagcaggagcacggtaagtgggaaccatggttatcccgggcctccacttccccacccaacctggcctctcttgcccaggtccctcccacccccacactgaccggtcccggctgtgcacagcggcgtgccgaatgacgtccttccggtagacactggtgtagctgcactcgtcacacttgtagggcttgctgcccacgtggttgaacatgtgctcctgggagacagacaaaaggatggtgggctggggcttggcctcctctcccatccccgtccccaccatgcctgtggccacagtcttagggttgctgcgggagcagctcacagaacacaggcatgtggacaacacaccccgacgcaagggtcaaaacctaggaaggcccggggactgtccccagcgagagcacccactctgtgccaggctctgtgctggctcacaacttgacaaagaaggaacctgagtctcagggtggagggaccttgcgatggcagagcttggagctgaagccaggcagcatggcgccgcagcctccacctctcccactgcgtcacgagacatcttctctgcagaacccacataacagcccacagcacagcgtgcacagagcacaggggctcgctctgaccaccgtgcccggaagtaccctctcccacagctgccaacttgcacattggccaggccgagccacagtttcctgggggtcagtagaatgggactatggacacctacgacctcattgggctgcaataaggatttaattatccagttactgcataaaaggctcagggctgctgcaggccacatggtagcttgtgttaaggagaaaaaggaaccgtttttttttttttgtttgtttgtttttttgagacagagtttcgctcttgttgcccaggctggagtgcaatggtgtgatcttggctcactgcaacctctgcctcccgggttcaagcgattctcctgcctcagcatcccaagtagttgggattacaggcatgcaccaccatgcccagctaattttgtatttttagtagagatggggtttctccatgttggccaagctggtctcaaactcctgacctcaggtgatccacctgcctcagcctcgcaaagtgctgggattacaggagcaagccactgcacctggcctaaaaggaacccttttcttgagacacatgactgccatctgctggaaatctttctaacacatggaatcagatgaaaacagttttatggcgtctgtggtggtgaagatatgctgccactgtgcactgtgccgcctgcaaaaccgcctgtggcagcccttcccagcccctccccacattcccgcaagctctgaggagctgagcgttcttcggtacgccagtgagccagacacgcgttctgaagagcagcaggagagcgtgacccagaatgctctgtgactccattctccctcagtggcaccagctggcctctgcttgccttcttcaccctcccatgagccccaagcctctttggctcccgcaccttgagcgaggaccagcggcgggaacgatagctgcactgcaggcacttgaagagctggggatcgccagcctcatgggagttgacgtggaagcgcaggtcctcgtgggacagaaagcgagaaccacagatgcggcacaggaagggcctcaaaagtggtttgggcgacttgtaatagtacctgcaggatgagagtgtggcggaaaggtctggtggggttggtggcttaaccacatgcatgccccaccctcacctctgctccacatacttgcggtatttcttgcctaggaagcgcctggaaggtcgacctcggcgccggggcagagtgtcatgctcatccgggcaggagggggctgcgttctctgcatctgactggctcacaccagcttccacaggggtcctgctcaccttgcccatggccaccaggtgtcctgggcctgaggagctgggagcctcgggatcctgtggctctggagggctctgtccactctgggaactcactagaggctctccttccacacctgccacggacatgccaggtcacaagccagccactgacacaccaggacagacgtggacaagtgggccagaggccagccaaaatatcctcccacccactcatcacagaccactgatgggtgcattgagtcacatgacacagacagcctgtggttagagggcagcatggatactaccgcccaacagccgacattctgtcagcacagtaggacctggcctggattagagcaacggcgagagctgggacctcccagtcaggagacctgggttccaggcacggctctgtcactgacatgctgtgcacctacagacaaagccattcctctcccggagtctcatttgccccatttatccaagggaggccagaatggcggctttggtgacttcacagaacaatctaaggctcgggaagcaataggagtgctttaacactggcattccccagggaggtcaggcagctggagggctgatgggagggaaggagggagatgtgacttccatgcttgcaaaccatttggacaatctaaatctgttacctcttcaaaaacattgacagtatttaaatattaaatatgtactagacaaattaacaatacagacaatgcaggtaatgttctgcttcttgactgggttatacaggtgcttggttacacaggtgtgtgcaccttgtgaaaactcattgacctgggcagaatatgtgtaactttccatacatatgtgcctcggtaaaaaggcctttttgaaatagagactaaagaatacaataggccaagtgcggtggctcacgcctgtaatcccagcactttgggaggctgaggtgggcagatcacctgaggtcaggagtttgagaccagcctggccaatatggtgaaaccctgtctctactaaaaaaattaagtcggtgtggtggtgggcgcctgtgatcccagttactcagaaggctgaggcacgagaattgctcgaacctgggagacaggggttgcagtgagccgagatcatgacgctgcactccagcccgggcaagagtgaaactctgtctcaaaataataataataataataataataataataataataatacaacaactctccaaccataaacagctgccactgtactcttttgtgtgtatttaacccttaagcaatcctaaaaggcatgctgctataacctccatgcataaataaagggactggagatttaagctccaagtcacacagactgcaggcggcagagctggtgctcacaccacggctgggtcctttctgtccccagccagtaatgctccgaaccagggctcctctgatagtcccaggcctcagacttattcctctcttctcatttcagtaatatttaaaacttatcttacgcattcagtgataaagtcccaaatttctcttttgctatgacaaattgtggtgaaaggcatttccataaagctgagagagtttcctgagtcagggtttcttgagcttgagtctttgagggctttcccctttccctggaggcctgcaggtgacccggtttgagacagctgccctgcagggcacactcagtccccagaactccacagagacaagcagggagagaggccactcctgacccacccacacgagcccctcccaagaccaagcctcaccatctgggaggtctgagatctccaggcggggcagcttccggggccggccaggtctccttcggggccttggggtactgggggtggggcgctggagccgaagctgccggcctcggggctcatcctcagctggattatagtcgctatcctctgtgggggacagtaaagttggtgaacagtgagtggcgggacctgccctttcagccctgaccccttgcccagctcacttccctacccctgcatactcctcctccaagcccacagcgatgcctcctccagaaagccctcctgatctcctctggctgacttggcgttcctgccctgagcccctgaagttctttctctacccttcctggcacctaccactagctcataaagcaccttcatgtgaatagggaaaaggcaacccttcctccagacactgtacagccagttagaaaaaagtttaaataaacattgaagtccacaaactctacggctgccctatccaaaacagctgccaccagccatatgtagctattgagcccttgaaatatgcctagtccaaactgagatataattaagtgtaaaataatgaatttcaaaaaattggtattaaaaaactcaccaataattttttttttttttggtattttagtagagacaggatttcaccgtgttagccaggatggtctcgatctcctgaccttgtgatccatctgcctcagcctcccaaagtgctgagattacaggcgtgagccactgtgcccggccaaaactcaccagtaattgttatgatgactgcatactgaaatattttagggccaggcacagccgctcacacctgtaatcccagtgctttggaaggctgaggtgggaggattgtttgaggacaggagtttgagaccagcctgggcaactcagcaagactctgtttctttttctttctttttttttttttttctgagacagagtcttgctctgtcgcccaggctggagtacagtggcatgatctcaactcactgcaacctctacctcccgggttcaagcgaattctcctgcctcggcttcccaagtagctgggattgcaggtgcccgccaccacacccagctaattttttgtatttttagtagagacggggtttcaccatgttggctaggctggtctcaacctcctgacctcaagtaatctgcccgcctcagcctcccaaagtgctgggattacaggagtgagccaccatgcccggcatttctctttttttttttttttcttttttttgagacagggtctcgctctgttgcccaggctggagtgcagtggcacaattacagttcactgcagccttgaccttctgggctcaagtgatcctcccaagtagttgagattacagacacataccacaacaggctaatttttgtatttttcatagagatggggttttgccatgttgtccaggctgggagaacccgtttctacaaaaattaaaaaattagccaggcatgctggcaggcacctgtagccctagctactcgggaggctgagatgggaagatggcttgaactcaggaattcaaggtaacagtgagcaacgatcatgatgctacactccagtctgagcaacagggcgaggacctcctctcgcacctttacttgtattctatttctgtggggcaaatgtgaacagggccccctgtgctcttttccagtgtgcaccctgcacaactgcacacagaagtcctggtcccagagcacaacctcctctgtcttatactggagggacctgtggatgtgtctgtgccaattcctctttactggccctccaagtgaaagctcagtgagtatgtctagatgggcatagggatggcaggcctagaaaccatggtggcctaccctccaggtcatcaatggctccagcgtctacaatgtcatcatcgtcctcctcctctggtccctcttcctcttggctcttggtggaggtgctccacttccgtagacgtccttttttaccagctgctgctgcggctgctgctactggaagtggagggagggtaagacaagcttgccatgtctggctcccagcaccccacccctacccatgcagtccaagcaggtaggctgctactgacgcacctggacggaagtggcgttcccgcatgtggcgcagcagtgtggccttggtgctgctccggtactggcacatcttgcatttgaactgctgcaccaccaccacctccatcatggcctccaggctctgcaggtccggctcttcggcaccggaggctgggggcagctgcaccggggagctgggcccaccctgtgcctccaggcatgtggatgtggatgtggggccatctgccagggcctcaatggctgctaggctgtgggccaaggtggaactggacattggtgatgtcatgggggctcctggggatgggtgaggcaattggagggtggttaaatggagggcagcactggccatgagctatagctacccctcccaggcaggcccagggagtgcagaaccaaattccccaccagaggccaacccgtcagtaggaaaactgagacccagagcagtggatacccagccagggccacagacggaatccgcggcagaacctgtcctcacctatccccctgcccactgcaggcctccccgattctggcacctggggtcttaccatcatctgggccctgtaggatcaggtaccgtgtggtctcggccccgccatcctcagcactggtcacagtgatgcagtctgggcagagatggggaagggtcacacctcctggggagggggtcccagcaacaggcccacccccatgggccccactttggcctgtgagcagggctggtccacactcattctggctcccatgtgcgactgcaaaccagctgtgtcacccctgagcctcagttgactcccctggcagggctgtctggaggtctagtgtgacatgctgactcagcagccggcccacacttacacaagatgccacagctacaccagctgcccaggctttgaccaccaaacctgggaagtcctccttcctctccaaacttctcaaagtaaaggaccagctcctgcaccactttcttagggttggcttcccagactatcccagggctttttgaggtgctatagcctctataaatatcattaacaaaaagtgggtacagcaccatgtgtcacggctcatgcctgtaatcccaatactttgggaggatgaggcaggagaactgcttgaactcatgagttcaagaatagcctggtcaacccagcaaaaaggtggtgtgcacctgtaatcccagctaccctggaggctgaggcagagaatcccttgagcccaagagtctgaggttacagtgcactatgattgcaccactgcactccagcctgggtgacacagctctggagtcagactgtctgagctcatggcccgacaccccacactgcttgctggtgacagtgggtaagttatgtatgtccttggtgcctcatatttttcatctggactgtgaacattaacatcctctaccttttggggttattgggaggattaaatgagctactgtatgtaaagtttagaacagtcctgggcacaaggtaagcaataacagtttatattatttattgagagtctgtcatgccaggcgctaggctgagaactttacagtgttgtctcattaaatcctcatttaccaccatgagacaggggtgactgttcccactctgcacattccacatgggaaagtaatctgcctgagttcacacagctagggtgggcacagctggctgccggacactgcaggaaaacccctgtggggctcctctgcctgactcactctggatgaggtcgggcccgatggtggactcgatgatcttgtcgatggccgagcccaggtccgaggaggaagctgtgcagtcggacaccagcatgttggggtctgggagtgcactagagtgcacaagtgctgggggaccgcctgtcacccctgccactggcccatgagacacagacgatgaatcagggaggtagctattaggcagggggtctgcgctcgagctgctctcagatacctcctcctgaggggcatgaaacagggagggaaaaagtttagcagctgggtatggggcagggcagcctgccagctcccacttgctagacagagctctcaggcccaaggacatggtcagtggagccactcatgccctcagccccacggaggaccagtgagagaggccctccagtcacagagtcccccaggaaaaagtcacagggtccctggatctcatcagggaatacacaaaaataagagaagggactcctaagccacagccagggggagctattttctttgggcttttgcataaatcgttccctctgcctgaaactcttcccagcatcaccctatggctaaatcttacccagccttctcaccaccatttagctggtacctcttctaggaagtcaatgctggctttgaggccaagtcaggacttcttcatcctcagtgctgcagctgcctgtgtccccagcaccacaccactgtggggttcattgtgccttttaacagcctccatgccagactgtgccctccacaagggcctggaccaaacttgtcttttcctctgctgtatttccagggcccagcacacgctgagcacatggtaggcccccatctctgctgaactaatgaaaccccaggaccccaaagtgatgaccactgctgtgtacttctatcacgtgatatactgaatatgaccattatcttgcatataagaatggctaatacttactgagtgcttacaatgtgctgagcactgttttaattattagctttgcatatgttaattcatttcatcctcacaaaaactctatgaggcaggtatatttaccattcccactttacagacgaggaaacagagctagatgttgggtagcttgctcaagatcacacggctaggaagtggcacagccaggaggagatggtttacaaaatgtttgcaagaggatgtctggtgggagctcacaatcaagcacccttgaaagcaagtatttctgctttactttagccgggatactgaggctcaaagaggtctcccagtaaactggaggcaggacccagtcttaacccagggcacttgcgtttttttttttttttttgtagagatgaggtctcgctatttgcccaagctggtctccaactcctgggctcaagtgatcctcccacctcagccttccaaagtgctgggattacaggcgatgagctaccactcctggcctagacatctgcctctcaaagtgtgaggactgtgggtagtatagtagctaagaccacagcctagatttgaatcctggctctgtctgcactctgtacctcggcatccttttctataagatgtgggaaaaaatggtatgtgtcttagaaggtatgaagctcaaatgagaaaatccattttaggggtttggcttggtgcctggctcacagtaaaccagaaacaccaagtattagctacaaacaagccttgtttcctcttggctgtcaggcactgctgctcgcggtccttgcctccacccacgccgtccagccgggtccatacctgagaacggctgccgcggtccgagctttgccccacgccagagtcatcggcctctgcctgccccggggcggccgcggcgtcgctgctgtcggcggacacggcttctgaggtgcccacacccaggccgctctcagagggctcctcgggccggccaggcccaggggccgcgtcgctgctgctctccacctcgttctcctccatctgatcggcgggctgcctgacagcggggcgtagggtctgggaacttcactctgagaagagaggtgaccgtggctggaacaagtgggccatctccccagccccggcaaccacggccacccatttgcacccctgcgcccattttgcagatgcgaagattgagtctccgacggggcggagcttcctggtgtattgcgaggggagctcgggaaaaacttgacggagaagctgtgcttcccaggctaaggcccttcccgggagggtggtcaatggctggtaatcttgaccctttccctcgcccccacgattctcgtggagcgttccgctctgtgagccccatccgggcccagtggttcagcccttcggcccccgcgtccccccgggttgcagggccggtggtacagcccgctggccccctgggtcagtggttcgctcccccccggttcccctgcggaggcggctgacagcgacggtctcggggcctggcgatttggggctgtccccggcgctgcctgtgctccaggcccgacgccatcttgtggtggcgccgggtttccgctcaggcaagtgcgagagcgactaaagggcctgggaccccggggccctgttcggacagccccgccggcctgggacctcgcctccgggtatccccgcagtgtgacctcactccacggcagggtacggtggggccgcctaactctacccgaagctcacccgaggctttcgtagccacgttcctctctgactccggcatcgacgaggtcgccatcctctttcctccgctgcggaggaacccatcggcctattgtaggccggaactacttcccccgctggccccgggaaagacacattttcagtgttccggaaggtcgctccgaggcctcaaaaccataatcgggtctcaacagactctgggactttatacgtcgcccggtgtttggcactgagcccactatggtttggggactactttatctcggcggagtgttacgtaggaagtggttgtgacgtcattctggtcccttccctaggccgcagggttgggcgcggcgaatgcgcgccccgctctcttggggcgtggctcccagtggggggcgtggctcccggtggcttggccgcgcccctcctacaacagcccggaagagcgtgtggccgcgggcgactttggcttggccaaagaggaattcatgttgtcagtcattttacctgactcattacttattacttagcgcgctgctgcaacccaatcgagctctgcccgttaggtttgatgtgttttgttgggaagggaatgtataattattgtacagatagggaaactgaggtctgggtatgggaagggctggtccaaaatcacatccaataaagggactcaggagctaagtacggatggcaggagtcggggaaatggaaagaagttaatgcttgtcccttaggtttgtatacatatttgttaacattaatagagctgaggccgggcgctgtgagtcacgcctgtaattccaacactttgggacgccaaggcaggagaatcgcttgatcccaggagttccaaaccagcctgggcaaaagagcgagaccccatctctacaaaaaaaagaaaaaaaagaaaaattagccaggcatggtggcgcgtgcctataatcccagttgctcgggaggctgaggtgggaggatcgcttgagtctgggaggttgaggctgcagcgaaccgtgatcacaccactgcacttcagcctgggcgacagagcgagaccctctttcaaaaaataaataaatacaagtcaactacctatcctttaaaagtggagaaagaaaaaaaattttaattaaaagtcagctgcccttaaggtatgtccttcctccggaaatgtcaccttctgttttaagacttttagcagtttgcagtggaagagcacaagagggagtaaggcgctctggtttttgtccctaagtctctgtagttccataggctattttccttaattgaaagatacaaattttgggggaaaaaaatctcaaaaaaactcctaagcaggctgggcgcggtggctcacgcctgtaatctcagcactttgggaagctgagtcgggcggatcacctgaggttgggagtttgagaccagcctgatcaacatggagaaaccccatctgtacgaaaaatacaaaagcagctgggcgtggtggcgcatgccgtaatcccagctattcaggaggctgagccaggacaatagcttgaacccgggaggcagaggttgcggtgagccgagatcacgccattgccttccagcctggggaacaacagcggaaactcttgtctcaaacaaacaaacaaaaagtcctaaggagaagacctattaataaggagaaaaggtccgggctcggtgggtcacacctgtaataaccagcactttgggaggctgaggccggtggatcacttgaggtcaggagttcgagaccagcctggccaacatggtgaaactgtctctactaaaaatacaaaatttcactgggtgtggtggcgcgcgcctgtagtcccagctactcgagaggctgaggcaggagaatcgcttgaagcccagaggcggaggttgccgagattgtgccattgcgacaagagagaaactccgcttcaaaaaataaataaataaataaaaataaaaaggacaaagggtgctttgagctgttatttgtgtgcacttgtgtatgaggggattcatctggtccttttcttaggtaaagttttctttcctaggtttcccttttgggttgagggaatggaacaggaggcctctggataggttaggaccctcatcccctatcccttgcaaccagcaggaccaggccccagagcagctctgaagagctaggtcagcactggcatgatgacatgttggttttactatctccaggcagttttcccgtgtggaccccattcctcagccctacagaagcatctgccccctcatgccagtagggtagtagggtgcatcctacatctgaccaagtcacctctcccaagtttggggtactccgaagtagccccacagtaccctcattcccttccccactaagactgaagcctcctaggaggtagagtctgcagtgaactatgagtgcgccactgcactctggctttggtgagagagtgagaccctgtctattaaaaagaaaaaaaaaagactcaaccttaatcctggcctttgccacagcatcacaagattgcagaatgtcatggtacagatgaaacagactcatcatgaaaccgaagaggagcccaaggcccagagggggaaagctaacagcccaaggtctcggctccttggaaacaacataccagaacccttccatcacaaagacaagcaggcaaatccttgtattctgcctgtgaatccagggtttgttcctccagagagtgcagtctagttctggtctcagctttatttttttgttttctctttaaaatttgttttatcttttaaaaaattgtttataaagatggggactagctattttgcccaggctggtctcgaactccatggccccagcttagagagacttatggaagcagtgaaggggctctgggtcagaggacattaaagtggaccattgagaaaaatgtagaagagccaagagggaaagaggagggaagatgccaggcagtgtgtgtgctttctgagtcatgttttgtttttttttttaatttgcttccacagagctttatttccatttggatcaaggcttggaagaaggctccagggtaattaaaaagctgcctagtggctggagggagaggcttaggcagaagccctgatactttgggaggggcccttaaggctcccagtcgtgcttgagggtgggtgagcctttccaagagaaccccacccaggccagcctgggggccagccaccctgggaaggttggtcaagtggtcgcccatcttgatgagtttcacttcctcatctaagaagtgactctctaggaagtcacagagatggaggtctgtgcgggcaggactcagggcttgaagatccaaaagcggcctggttcagatttttctccagggccatggcggcttccgtggcattcagggtttttaaaatttatttatttattattattttttttttgtcacccaggctggagtgcagtggtgtgatctcagctcactgcaacatctgcctcccaggttcaagcgatccacctcagcctccttagtagctgggactacaggcgtgtgccaccacacctggctaattttttttgtatttttagtagagatacaatttcaccacgttggccagactggtcttgaactcctgacctcaactgacccacctgccttggcttcccaaagtgctgggattacaagcatgagccaccacgtccagccgtgtccagggtcttatctaactcaatttgggccagtttctggatgtcctggaagagaatgcagccgccatactggttttgcatctttaaggcacccttgcgcttctcctcggccaattcgtggaagaagtgacccacgccctcccaagccacatcgtcacagtgtaagtagaagcccagagagaggcagatgaggaggcctgcaggtgcaaattgagcaggtggttcacggctgcctccacctcagtggaataattctgacgaatctgggagctcatgggctggtaagaaggagctaaccacaaacaatggtgttggctggacccagaagcagaaggtggctaaaaagatggtccctgaggttgcaagtggagaggagattgatggtgagaggctggaagagaggaagtcccaggatctcttccgtccaaacactgttgaagcaagacacagatccgtgggactgcccaatgtgactctgctgaggagtcatggtatcttaaggaaacaggagttgttaaatcatcttccactgtagagaggaggcggctgaggctcagagaggggaagagacttttccaaggtcatgcagccaggaggatggagctggtatatggaaccaggtctgcctcattccatagtaatcatacacttaggccgggtgcggtagctcacgtctgtaatcccaacactttgggaggccaaggcgggaggatcacttgaggtcaggagttcaagaccagtctgaccaacctggtgtctaccacaaaatacaaaaattagccaggcatggtggcacattgcctgtaatcccaactacttgggaggctgaggcaggagaatcgctttaacctgggaggtggaggttgcagggagttgagatagtgccactgcactctcgcctgggcgatagagactccatctcaaaaatacaaaaacaaaaacaaaagcaaaaaaagaaataccttaaattactctgtgccggtcaccattctaagtggtttatttacattcatttatttatcctcacaaccaccctatgaacctacgaagtggttgtcattattatctccattttacatatgaggaaactgaggcacagaacaataaaagaatctacctaagtaaaggatggagctaggattgaaaactaagcaatctgttaggctgggtgctgtggctcatgcctgtaatcccagcactttgcgagaccgaggcaggtggatcaccagaggtcgggagttggagaccagcttgaccaacatggagaaaccccgtctctgctaaaaatacaaaattagccaggcgtggtggcgcatgcctatagtcctggctactcgggaggctgaggcaggagaattgcttgaaaacccaggaggcggaggttgcggtaagctgagatcgcaccattgcaccccagcctgggcaacaagaatgaaactctgtctcaaaaaaaaaattattaatacttttaaagactgagctgtttaagaatttttgggggaatgtttctagcagtgactttttttggcctttttaacataatgatagtgtaaagacaggagccttacaacttagtcaaagcatttcatgtgcagtccttcttctatctccttaaaatatgtatttattttacatacagacttttacactaactattgaaaaataaagtaggatctgctacagtttcccctgaaaatttataaaaagtgttgagattgttagaaggcagtttttaatacaggtgcactaccctaaaagacttgtctattgtcaataaagtatttgtgaaattattatttctgttcagaaatactatttcttaaatctcctgggaatttgtggcatactaaagcacattcaaagttctaatgtgtttatgagctcattttcaaaatagtaagtttgtcatctttaaaatgaacgtaacttgcttccttgatttctgaaatgaattaactgaagattgctatagtaatctttatttcatctttctagagttgttggcaatttttttatacaacagtgaccattagagaaggggggaagggattttgggtgtgtatttgtaggtactaagggatttactaaatatagtagagcactgtcacacttgttcaagtagtttcaaacgtagaaaattaagtatcagaggcaggtatagggagcaatgtagtcttttttttttcttcaattttaaaaattttaaattgtggtagaagcaatgtatccttaaggtgaaaaacctacctcagttacatgtggtttgtgttttctggattaatctggattttataattagaaataaaaatgtaagattttgaatccacttaataatttcttgaaaataatacaagtcagtgtaatagagaagcattcatatattcaacactgtaagacaaaacagcagagaccttggatttgataattgatctgatatcctggacagtattcatatgtacagtgataggtatgtttctttggggtttttttgtgtgcatatgtgtgtagttttatcgttctgagttggtgaccagtaagttccatgtagtgctggcacttatttaataactattcatgattttgttaataacttgttacaggattcaggcatatattttcagcataagaagccagacacaccagcttgtcattggagataatatattaagtgagaaaaacattcaggaatcagaactttaacatgttaaagttagtgctaaacatggtcatattgggtctgaacctatcctaatatgtaaccataaagcttgacttttgcattggaactatgctttcataaataaaggatatcccatgggattgtaattgtaatcccatattatctgtaattgtaattcccatattatctgagaagtagtgtgacacctttcttttgttgttacattaagctgaaaacataatactaatagacgactaacagtttgcttatcaggcacatcaactaaggcacctccccccatgctaagtttctcctggatatatggaagttggttgtttcccagtttaaaaacttgaactaatattacctaagaaaacctgagcccatattgtttttattttacttagctagaatctcatagcatgttaaagtcataccttatccccactaaaaataactatgtctatgtgagaggaatattatgtgtgggagctgtattaaatactattataggtgttacagaatctttaaataaatggacgtggaccaaccttccatctagtagtgtacgatctatatagtgcatgtcagtagcacaaaatgcagtcttagttagcattagcctgtctaatctgaatagtttactcaaaagtacttctttgtgttaattattcagccattgtttttagatctagttaataggttctatttaatttgctgcaacatttattgaatgggtgagtgaaagaactgatgcatattgggaaatatcttaccattttttaaagataatgttacattaggaaaagaacacttttaaggaatttatagcagtgatgaaatgaattcagtctatatcagatacaccaaactgttgatggtatttaaatgtgactgcaagttagtatttctgtatatattattgattactggtttgtttttagatatgtaagtctgtcctaatctacggttcacgtattgacagttgctctggtaataatagaatgttagtgatgatcacttggtggatgttgattaagtgcctgtgttttgttttgtttcctcctctggataccaaataggtgtatgctacttttttggtgaacttatttcttggaagatttggttatgctattcagggtttttattcttatgtttttcttctaaacttaagcagcatcctgctgctaccatattaaagctcaaatttaacttttgtggaaaaatcagctaattcaggtaatccaaatatttgtggaaaaacatctgggtaatttattgaccacattagtattgtgtagacagctttgattattcccattgcataggtttttattgtagaatagtcaacttaatatagattcacttttaatttacatgtataaagtaatactcaataaaaattttttcatttatttaaaaaaaagaaaactaagcaatctggctctagactccatacttttagattgctgtaccatttctcatcataatgcttgactcttaggtgatattttgtcttctcctgagtcaggcctggtggttactattttcccattttacagatgaggaaattgaagcccagagaggggatttgacttgctcaagatcacagaaattttctggtgtaatggaaggggctgtgagcccaggccagatctcctgcagtagataataatcacactagcagtttttaattaatttatttatttttttgagacagagcatcgctctgtcgcccaggttggagtg[140 bp omitted]gtttcaccatgttggtcaggctggtctcgaactcctgacctcgtgatccgcccacctcggcctcccaaagtgctaggattacaggagcgagccactgcgcccggccactagcagattgtttgtttgtttgtttgtttgtttttggcttttttgttttttctttgagacagggtctcactctgttacccaggctggaatgcagtggtgcaaacatgggtcgctgcaaccactgcctaccaggcttaaacagtcctcccaccacagcctcccaggcagctgggactacaggtacgcgccattacacccagctaaattgttttgtattttttgtagagatgggttttccccatattaccccggctgggtgaatgtttactgggtacttaccaagtatcaggggatgcattcagtgttttgtatgcatttttatttttattttgagacaggatctggctctgttgcccaggctggggtgcagtggcagaccctggctcactgcaaccagtcctcccaagctcaagtgatcctcctacttcagcctcctgagcagctgggactacaggtgcacaccaccacacctggcaaagttttgtatatttttttggtagaggtggggtttcaccatgttgcccaggctggtctttttcttttttaagatggagtctcgttctgtcgcccaggctggagtgcagtggtgcagtctcggctcactgcagcctccgcctctcaggctcaggcgattctcctgcctcagccttcgagtagctgggattacaggcacgcaccaccatgcccggctaatttgtatttttagtagagacgggattttgcggtgttggccatgctagtctcctgacctcaggtgatccacccacctcagcctcccaaagtgctgggattacagatgtgagctaccttgcccggccctatgtgcatttttaaactacagtcacaacagccagagatattagatgctctctgcattcccatgttacggatgaggaacctgaggccccagagcagtgactgtctgaggtcatgtgcttgatcgtcagcagaggtaggattcaaaccctggcttactgactcccagtccagtgctcctcatgttgcaccagatgccccggaagggcagcggggttgagagtaggcagccagcaggtgggtccgagggttcatctctacctgctttcttcatgtcactgctgtctatgggtttagctaaccctgtttttaaaaacctatttatagcttaagactgtaccaccacttgggataatgagtcccttaagttgacttcccacggtgtaaattaagatttccttctatttgtcctaaatctttctctttcagtattggagggggatggggtagtggggaaatgccctagggccacaacacttggatttagaaaataggctgaatgggctgggtgcggtggctcatgcctgtaaccccagcactttgggaggccaaggtgggtggatcacctgaggtcagagtttaagaccagcctggccaacctggcgaaacctcgtctctactaaaaatacaaaaattagctgggcataatggcggacgcctgtaatcccagctactcgggaggctgaggcaggagaattgcttgaactggggagacagaggttgcagtgagccaagattgtgccactgcactccagcctgggccacagagcaagactctgtctcaaaataaataaataaataaaataaaagaaaaagaaaataggctgaagtccaaatagtatttgactgtttgtatgtgatggtaattcctgacaccaggcagcaggcgacatgtatggaaacatctcatctgatcattacaaagacataaagggtaggcagggcctggatttttgtctcctttaatctgtcttgtttcctgtggtatcctcaccattgagcacattttggagatacaggtagatactagatagctatttgttctatgaatgaaccaatgaaccctcattttatagacaaggaaacaaagacccagaatatcaggggtctagccaggaaaacaagacttctaccactactagatgattccaaagagggaatttaggccagatgaagtggttcacgcctgtaatctcagcgctttgggagaccagggtgagaggatcacttgaggtcaggggtttgagaccagcctaggcaacatagtgagacccttgtctgtacaaaaacattgttttttttttaattagctgggcatggtggcatgtgcctgtagtcctagctattggggaggttgtggtgggaggatagcttgagcccaggagtttgagtctgcagtgagctatgactgcgccattgcactccagcctgagcaacagagcaagaccctgtctctgcctctaaacacatacacacaagacacaacacaacacacagagggaacttaatgtggagaattagctacaaagttgttttatgggtagaaatagcaaccaggggaagttgaggcaaacctgagattagcaacttcatgaagctgctacctcacccagggctggaagtattcatatcaagggaggaggtagcattactggagaccagcaactggggccaccctgagagaagctggaatcacagcaggtctgtctagcaggagctgaaccatgaaggagtcattgcaactgctaaagatccccccaccccatccttcccgaagacgagagaaatggaggagaaagaccctggcttctcccttctttctctccagtctctcaccaggacttcccattggccaatcctagccaaaagccagttggcaagggagtccaggaaacatggtttgcagggattagcctctgctgcacggagcagagcagaagggcagagaatggatttgagacaaacagaaaaattacctggcccaaattatcccatacctaggaaggattgcattgtgtatgcattgtcaggcagtgcccctcccccaagtccatgtgacctttttagtctctttatctttctatgtctgccttaagtatcacctcttccaggaagccttcttcccagcagagctggtatttcccttcagcgcgttcccctagcatgctctgcctacctctgtcacagaacacacaccaccgtgagatgctgccagttacctgccaggctcctcgatggacggagcctcccaaagccagtcctgagtctggtttgtttctctgctgagcagaaaatgattgttgaatgagtcagctgttggaaggataacatggggcaaggaactctagagtcagaccaaactgagggtccacaagtctcagtctcctcatctgtaaaacgggaactttgaggagtaaaagagagaatgcgtggcagtgcagttaagctcataggctctggaatcagaacatctgcagtcaacccccagctccgcttggagttacttaactttctactcctctgtttctctcttataaactagggatgatattaatatttcatatggtatctgtgaggattaaattaaactgtgtggaaaacagtgcaagtgcttaataaatgtacctagtattattatgtgtggtgcctagtcacatgcctgaacgttgcataggtaagaggatatatatcaaacagggaactttctttctttctttctttttttgagatggagtcttgctcttgtcacccaggttggagtgcaatggtgcgaatacaggcgtgagccaccgtgcccggcctttaatttttaattaaaaaaaaatagagatgggggtttcactatgttacccaagctggtcttgaactcctggcctcaagcagtcctccagccttggcctctcaatgtgttgggattacaggtgtgagccaccgcacctggccaggatcttgtctttcttgttgaccactgtagccccattaccaagcatagtcactgaaacgtagtaggtgcttagtcaatctttggggttgttttttaggacagggtcttggtctgtcaccctggctagggtacagtggtacaaacatggctcagtgtagccttgacgtcctgagctcaagcgatcctcccacctcagcctcccctgctcccaagtagctgagaccacaggcctgcaccacacgaatttttttttttaatttttttttttttttgagacggagtctcgctctgtcgcccaggctggagtgcagtggcgcgatctcggctcactgcaagctctgcctcccgggttcacgccattcacctgcctcagcctcccgagtagctgggactacaggcgcccgccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcctggcctttttttaatttttattttgtagtgacgaggtctcaccatgttgcctaggctggtccctaacttatggactcaagcgatctgcctgcctcaatccccccaagtgctgggattacatatgtgtgccaccacccctggcttcaatcaatcttttctgggccatagaacaatggctgagtttcatttgataacatcagtctgcctgtgagtccagtgtctagttctgtgaccttcccctctgtcccaggcaccacagaggatattcggcctacaccaccagcccaaccctggcactgaggcctctccaacaggtcaagggaccaccctgggattaaaggtggggactttggagcctgggaggagggggcatgcatggaagcagacaagggtctagagcaaaggactagcaaaggaatctaacacttattgagcatctactgtgtgccaagtgctgtacacactttattgcatttcatccttacagcagcctgcaaagcacagattgttatgcccacttcagaggtgatgaaatgtgagttccaggggtgaagacactcaccgaaggtcatacagaaatgaaggagcacagttggatttgaactccagactgtctgactcaaccccctgttcttttttctttcttttttttttcttttgagacagagtctcgctctgtctcccaggcaagatcttggctgtacagtggcaagatcttggctcactgtaacctccacctcctgggttcaagcaagcacatccagcttatttttgtatttttagtagagacaccgctttagccaggctggtctcgaactcctgacctcaagtggtccacctgcctaggcctcccaaagtgctaggattgcagatatgaaccactatgcctggtcctccctgttcttttcactgtacccaagctgcctcccagaggaaggaggaggtaggggaatggaaggcaggaggaggcaggggaatggaagctgagcctcaagccatacgggaagccatgagagccaatgctgaggccaggctcaggcagaatgacagcttgagaccatgactttgacagctgtgccgaggttggcctgaaagcaagtggctggggaagacgagctgtgattgtcaagacaagagatagccaggggcttcagcagggcgctgaggaggtgctgggccccgaacagaatgtccttgagccccgaacccaacagaacaagctccctacttacttgctctgtgaccttagcaagtcactcaatcatctcagttgggcgtcctcacttgtcacacagagtcaccacacatgctgagttgccaagggatgacatgagacaatgcaaggagacagaactgggtcaagtccaggtgaggactcaattaccaattaatctatgatctgaggcaagtcacttcacctctctaagcctcagtctccctacctagcaaatgggcacagctcctgtcacaccagtttgctgtgaagatgtagtgattaaagtatgggctctggagtaggtttccctgggttcaaatcatgttccaccaccttaagttgcttggttcttttctttctttctctttctttctttctttctttctttctttctttctttctttctttctttctttctttcttcttttctttttctttcttttctttctttctttctttctttctttccttccttccttccttcttccttccttccttcctccctccctccttctctctttctttctttcccctctctctctttctttctttttttcagacagagtctccctctgtctcccaggcaggagtgcagtggcgcaatttcagctcattgcaacctccacctcctgggttcaaaggtgattctcctgcctcagcctcccatgtagctgggattacaggctctcgccactgcgctcagctgattttttgtattttttttttttttgtagagatgggttttcgccatgttggccgggctggtctcgaactcctgacctcaattgatcctcccacctcggcctctcaaagtgctgggattataggtgtgagccatcaatcccggcagttctttttttttaagccccttcctgtctaggaattgctaggtttttctgtaccttggtttcctcccctggaaagtggagggtgaagataagcacacttacttcatggagatgtgatattaaatgatctcctcaccaggaagaacgcagaatggcgtctggcacaggtgagctctctgtcactgaaatcatgagccctgggtctagcacctaatagtaactaatgcttgctgcttgatgggcaccactttggacactttacgctttgactgtaatcctcaaagcagtcctatgagctaggtaatatgactgtccccattttatccatgaggagctgagttattctgatgtccaatgacttgccagaggtcacacagcagtcaggtcccagaccaggatttgagctctggcagactctgttatttattcatccctaatgaagtcttcacaaatggtgcaattaggacgtctacgttatgtatgaacgtgttttggaaccagaagagatgtaagtggagaatgccttcaaggagccctaaaggctgggcgaggagggtggggtgaaaggatggagggaccactctgttcagctcccgtttgctgccagcagggggcacccgctgcctccaccaggtctcccagacctgaaccaggaggccgggctggagacctgtccagtggcccatccaggcggaccttggggaccacgcgcaggggctgcagagagtggcggtgttagcccgtgcaaagccaggggcatgccaagagaggtttatctccccaagcgggctgcggagctgcctcaaacagaccttccaaaagatgcagatgcttcagcctcatctggcccctcctcccagcagaaccttctgggtggccaggcgccatggctcaggcctctaatcccaacactttgggaggccaggagttcgagaccagcctgggcaacacagggagacccccccccccccgtctctaaaaaaaagttaaaaaaaattgccgagtatggtgacgcgtgcctgtagtcccaactactccggaggctgaggtgggaggattgcttgagcctaggaggtcgaggctgcagtgagctgtgatcgtgccattgcacgatccagccaggtgacaaaatgagacaatgcctcaaaaacaaaaaaatacatatatatatatgtatatgggctgggcacacgtggctcacgactgtaatcccagcactttgggaggccgaggagggcagatcacttgaggtcaggagttcgagaccagcctggctaacatgattatctgttccttgtgtaccctccagaaatgttttttgtttgttttttgagacagagtcttattctgtcacccaggctggagtgcagtggtgcagtctcggctcactgcagcctctgcctcctgggttcgagggattctcgtgcctcagcctccctagtagctgggattacaggcatgtgccaccacgcccggttaatttttgtattttttagaagtgatggggtttcactgtgttgcccaagctggtctcaaaatcctagcctcaaatgaaccacccttctcagcctcccaaagtgctgggattacaggggtgagccaccacacctggcctagaaatgttttaggaatacacacaactaattttgattaccactactttgaaaacattttgatcaccacaaaagaaaaccttgtatcaattaagcaatctatctttatttcccctcacaccagggtcatttattttgttttgttggcctttttttttttttttgagatggtgtctcactctgtcacctaggctggaatgccatgatgccatctcagctcactgcaacctacacctcccagatttaagcgcttctctcacctcagcctcccgagtagctgggattataggcacccaccatcaaacctggcaaatttttgtattttgagtacagacagggtttcatgatgtttgccaggctgatcttgatctcctgacctcaggtgatctgcctgcctcagcctcccaaagttctgggattacagacgtgagccaccgtgcccggccaaccatttgtttttatggagctaaatttattgattttttttttttttttgagacagagatcttgctctgtcactcaggctggagtgcagtgttgtgatcatagctcactgcagcctcgaactcctgggctcatgctatcctcctgcctcagcctcctgagtagctaggactacaggtgcacaccaccacaaccagtttattgatctttttcataatggcccgaagattttgtgccgtgcatgggaatgcttttctcacttgattattaaaaggcaaaggaggccaggcatggtggctcatgcctgtaatctcagcactttgggaggctgaagtgggtggatcacttgaggtcaggagttcgagaccagcctgaccacatggtgaaatctcatctctactaaaaatacaaaatagccaggcatggtggcacacgcctgttatcccagttactcgagaggctgaagcaggagaatcatttgatcccaggagacggagtttgcagtgagctgagatcatgccactgcactccagcctgggcaacagagtgagactctgtctcaaaaaaaagcaatggatttgcaaattattattaatggtcagtgaaattttaaaacctgggaaccactgttgtagatcaccctccctagaataggagttcctggaagtgtagggacctcccatttgtccccatctatagcccccagaacaaagttggatagtgagtaagtatgcagtaaatggtggttaaaggcagtttctacctccagattataaaaggaaaacatctcatattctcttctagtccttttagggtgtgtttttttaaattatgttttttatccatctggggtttattttagtgatgagaatgaggtagagatacagctttttttccaagtggctagccagttgaaccaacaccatattgaataatctatcttccccctactgatttgaaatgccacctttagcatatactcaattcccacatgtatttgggtctatttctggactccctatcctgtcctggtgatggctctgtctgggattctatatttttttgaagctccccaggtgattctgatgcagccagtctgcagatggtgcttatctatgatgagatatttttgtggattcttagcaatgaaggaaaaaagagtatcacaaacttaaatttctttctgagggtccttcttttattttgtgattatgtacttactatacttttgattttaagatttttaaataaattaacattgatagtagattagtagatggtcattctggcttatttatttccaagtactttttttttttttttttttgagacagagttttgctcttgttgcccagtctggagtgcaatggcatgatctcagctcaccgcaacctccgcctcccggattcaagtgattctcctgcctcagcctcccgaatagctgggattacatgcacatgccaccacacacagctcattttgtatttttagtagagacagggtttctccatgttggtcaggctggtctcgaactcctgacctcaggtgatctgcctgcctctgtctcctaaaatgctgggattacagtcgtgatagaattgtatacttaaaataggtgagtcttgtaggcgtgagccactgcacccggccttctaagtacatttttaaaggagtataacatagagaacatagagaaatgtgcacaaactgtaagtgtacagcttgatgaattctcactaattgtacacacctgtattagtatcatacggctgctatcatagattaacacaaacctcgtggcttaaaagagcagaaatgtattatcctacagtttggaggccaaaagtccaaaatcaaggtgttggcagctctagaggagaatccttccttgactcttccagcttctagtagctccaggagttccttggcttgtggcagcatcacaccagcctctctgcctccatggccttcttctcttcatctctgtttcaaatctccttcagcctttctctctctctctctcttttttttttttttttttttttgttgttgagactgagtcttgctctgttgccaaggctggagtgcagtggcacgatctccactcactgcaacctctgcctcctgggtttaagcgattctcttgcctcagcttcccgagtagctgcgattacaggcctgcaccaccacacccggctaatttttgtatttttggtagaaacggggtttcaccatgctggccaggctggtctcgaactcctgacctcaggtggtccacctgccttggccttccaaagtgctgggattacaggcacgagccatcttgcctggccagcttttatcttataaggacagccagtcattggatttatggcccacactaatccagaatgatctcatctcaagatctttaattccatctgcaaagacccttttttccaaataaggtcacattcaggggttctaggctaatatatcttattactgatggggagcacaattcaacccatgacatcacccatgccaccaacaatcccatatcaagaagtaggatgggccaggcgcggtggctcatgtctgtaatcccagcactttgggaggctgaggcaggaggatcgcttgaacccaggagtatgaggttgcagggagctctgatcaagccattacactccaacctgggagacagtgagaccctgtctcaaaaaaaaaaaaaaaaaagaaaagaaaggaaaataaataggatatcatacaatgccagaagactcctccatactttgcctggcagtggagtgaccactatcttatcttaattttcttcttcttctgtttttttttttttttttttttttttttgaggcagggactcagcctagcccagtctggagtgcagtggtgcaatcacagttcactgtaacctcaagctgggctcaagtgatcctcccatctcagtctcctgagtagctgagactacacagacacacacgaccaagcccagtgaattttttgactgtggagacgaggtctcattatgtcacccaggctggtcttgaacccctggactcaaacaatcttcccgctgtggcttcccaaagtgctgggattacaggtatgggccactgcacctggcccaactttttattttgaaaaattctcaaaccttcacagaagttgcaggagtagtacaatgaccttcactcataaccttcatctagactcaccagttgttaatatatttctatatttataatacttcctcttctctctctctatttatttatatttatacatgtaatactttttttttctgaaccacaagggagttagttgcacacatcttcacatttcacccttaaacctccaaagaataagggcagtttcttacataaccacagtacaattatccaacatataatctacattcaaatttctcagccgggcatggtggctgacgcctgtgaccccagcactttgggaggcggaggtaggcggatcacctgaggtcaggaggttgagatcagcctggtcaacgtggtgaaaccccatctctactaaaaatacaaaaattagcggagcgtggtggtgcatgcttgtagtcccagctacttaggatgctgaggcaggagactgcttgaatctgggaggtggaggttgccaagatcgcgccactgcattccagcctgggcaacagagtgagactctgtctcaaaaaacaaacgaacaaaccaaaaaataaaaaaaccccacaaatgtctccagttgtcccacagacatcccttaatgtgggcaatttaaaacattaaaaacccagggtccaatcaagaaattcacattacttttagtgttcatgttctctttcttgtggtcattatttgactgatttatttatttatttatttgacagtctcaccctgttgcccaggctggagtgcagtggtgtcatcttggctcactgcaacctccacctcccaggttcaaatgattctcctccttcaacctctcgagtagctgagactacaggcacacgccaccatgcccggctcatttttgtatttctagtagagacagagtttcgctgtgttggtcagctggtcttgaactcctgacctcaggtgatctgcctgcctcggcctcccaaagtgttgggattacaggtgtgagccaccgctcctggctgagatccagtttcttaaataggttctggggctttagaagttggaggactagctgggcacggtggctcgtgcctataatcccagataattgggaggctgaggtgggaggatcacttgaacggagacgttcgagtacagcctgggcaacaaagtgagacctcctgtctttctatttaaaaaaaaaaggaagaaggaaggaaggaaggaaaaagaaaggagaggagaggagaggagaggggaggagaggagaggcgaggggaggggaggggaggggagaggagaggaggaaattagaggacccctgagtcaggggaagctactctagtctctaaggtcagcctgagtggggttttggggtgctttgcagggaagagaggaacctcgcctgctctcttcgcaggctccaggtctgctctgagcccacatctgcccgaaggcatgcccgctggggtgttccttgctgagcgagtgaggcaatccctgcaagggaggtgtggtggttctggcgtgagcctgaaccttggggcaagagggaaggacaatgtacttctcagccattgcagggtgtgtgtaacctgccctgccagtgggtgactcaggctgaaaccagacccagcattcaccctgtctaagcctagttggttagtgtctggagtgctgtcaattgctttacatttgcccttcagggaaatgcttttgcactgacaggcggggcccagattggaggttgtcaaatctgcaaagccctactcctccatttccacatggcagactcctattcacactccaaaacccggcccaggtagtgctcctgctgaaccctttcctgacctctgacccctcccccatggagtgaataatgttgtcttccaatatgcactctggagccagactgcctgggtgtgaatcccttctctgccacttactagctgtgtaatcttggtcaagttacttaacttctctgtacttctacatctgcggaatgggaaaaattatagcacccatttcactgggtagttgtgggggttaaatgagttattatacataaatacttaggacagtgcttggcacacaatatgagctcaaaaagagctgactagtattactcttattattattattatttagacagagtcttgctctgttgcccaggctggagtacagtggcttgatcttggctcactgtaacctctgcgtcccaggttcaagcagttctcgtgcctcagcctcctgggtaactaggattacaggcgagtgccaccacaccccactaattttttttttttttaggttttttttttttgtatttttagtagagacggggtatttttttttttttttttagatggagttttcgctcttttcacccaggctggagtgcaatggcgcaatcttggctcaccgcaacctccgcctcctgagttcaagcgattctcctgcctcagcctcccgagtaactgggattacaggcatgtgcctccacgcccggctaattttgtatttttagtagagatggggtttctccatgttggtcaggctggtctcggactcctgacctcaggtgatccgcccgcctcggcctcccaaagtgctaggattacaggcgtgagccaccgcgcccagctgagatggggtattttgtatttttagtagagatgggggtttcaccatgttggccaggctggtcttgaattcctggcctcaagtgatcctctcaccttggcctcccaaaatattgggattacaggtgtaagccactgcgtccggccactcttatgtttgtatttaagaaatacctaaggctgagcgtggtggctcatgcctgaagtctcagctactccagaggctgaggcaggaggattgcttcagcctaggagtttaaggttacaatgagacatgatcgtgccactgcactccagcctgggcaatagagcaggatcctgtctgtcaaagaaagagaagaaatacctgagaatatagtgaacacagcacataagtttcctgcacccatgatatgttctcagcctgtgtggacagatagacaaataaacaggaaattcactctgaatgatgaaaaatgtctcagtaagggaagtggtgggctgaggggagtcatgggagcacagaaaaagcccccttcccaggttggggtggtcagcagcattttcctggaataaatgacaactcagctgaaatataaaagatgaataagatttagccaggcaaagagggagggcagagaggggaagcgtgggaagggtttgaggcaggagggatggatagtgcaaaggctcagaagccagagttcttgatgtatttcaagaaccgaagctcaggatggagcgtggatcccggagcgtgggtgggtgggtgcccttggcatatacaccagttattcactgtgtctctttgtgatctgtcttccttcctagtgtgtgagctcctgcaggacaaagctcacatctccttgaattccctgcgcccagcacccagctcagcactcagcagggattcaataaatgtttgctgaatggaaatgagaaatttgagaacccatcagggagccatcttgggcaaccttttcatttgcttaacctgtgaatttggaattcttgttagccttgggctattcttaatagccaagtttatttgtttgttcagaattgtcatctgctgtgcgtctcagactcctctgaatgaggtggttctgtccgggcaaagtcaagtttctggcccaacaaggtgaaacctgatcctttgagtccctctctggatgccattctgtaaactttctttcttaccatctgtaaactttctttctttctttctttccttccttccttccttccttccttccttccttccttccttccttccctccttccttccttcctttctttctttctttctttttgagacagtctcactctgtcacccagactggagtgcaatggcgcgatcttggctcactgcaacctccacctcctgggttcaagcgattctcctgtctcagcctcccgagtagttgggattacaggtgcacactaccatgcctgcctaatttttgtgtttttattagagacggggtttcaccatgttggccaggctggttttgaactcttgacctcaggtgatccacccacctcggcctcccaaagtgctgggattacaggtgtgagccaccgcgcccagcaattttttttttttttttttttttttttgagatgaagtcttgctctgtcgcccaggctggagagcagtggcgccatctaggctcactgcaacctctgcctcccaggttcaagtgattctcctgcctcagcctccccagtagctggtattacaagcgcccgccaccacgcccagctaatttgtgtgtgtgtgtgtatttttagtagagatggggtttcaccatgttggccaggctggtctcgacctcagatggtcagcctgcctcggcctcccaaagtgctaggattacaggcatgagccaccgcacctggccaaactttcttttttttttgagacaagggctcgctctgtcgcccaggctggagtgcagtcgtgtgatcacggttcgctgcagcctcgacctcctaggctcaagttatcctcccacctcagcctcctgagtagctaggaccacaggtgcatgccaccacatgtggctaattttttttactgttgtggagaaaggaggagggagaggggagtctcattatcttgcccaggctagtcttaaactcctggactcaagcaggcctctcaccttggcctcccaaagtgctgggattacaggcatgagccatcatgcctggtcatctgtaaactttcaaactttgccttgtatcaggtcacctggggatcttatgcaggtgaggcagattctgattcagtatgtctgtggtctggcccgagattctgcatttctgactggctcccaggtgatgccaatgctgccggtccgtggattacactttgagtagcaagccgttagacaacattcacatctttcctggccctcactgcaatgacgactttaaaagcaggttggagtcaggctcagcagggccttggatgccaggctaaggagttcagcatttattctggaggcaataaggagctggatgctgggtgctagaggggctgagctattgcaaaaacaggagagagaggtggcaaggctgaagctcaggcagaggcagtgggaatgcagaggatggtggtgtcctgggctgaactgtgttcccctcaaaaaattcagtgttgaaaccttaacccctagcacttcagaaggtgactgtatttggagatagggtatttaaagaggtaattaagttaaaatgaggtcatgggaatgggccttaatccaatatgactggcgtccttaagaagaggaaattaggacacagacatgcacagaggggagaccatgcgaagacaaggaaagtagacggccatctacagacccaggaaggggggctcagaagaaaccagccctgccagcaccttgatctaggacttctgcctccagaactatgagaaaatacatttctgttgtttaagccacccatctatgggactttgttatggcagcccatgcaagcaaataaatacagaggggctggattaaagaggactgtccaggttgtcagttacttgaatgtcattgtggggggctatcggatgccatacaggtgatttggaaattgggaaggcctgggaatgaataggaagctggaggaggggcccagagggaggagcagggctggggaggactggatttggaccaggttacattggaggtgccactgggacctcggcaggtgctacccagggggctttaggaaatgaggccagtggtgctttccgttaaagccaggcactcagggagtgaggagaaggaagagaatggtcctgtattagtgggggccctgggttttaaataagcaaaactggctcaggctaacttaagcaaaaaggaatgtactaaacagatttctggaggctcacagcagcgatgtgaaggctcaaggccaagcttggaaggtgagctggtgtcgagggagactggcccacagtgggcacgatcaggaacgcgtagcagggtcagcctggactgaccctggaggaccctcaggactgctgggctctgctcatacatcaatccagcagtctcctaagattcagagatctggggggagcatcctatggcccaaacccagtcacatgtctgcatccctgatgcccgggggaggtttccagtgggaggatacctctccatccctggaagattaaagatggctgcatgctctgtgatactcctttcatatcacaggagatagagaattgggctctatcttcctctcctggcctgtgactgctttggccaatagaatacagtggatgtgacactatgccagcttcaggcccagactttaagggaagtggcagcttctgccttggtctctgggagccctgagtcactcactccgtaagaagactgactggagagaccacatggagattacgtggggaagggagaagggcacactacagcccagccttccagctagctctgccaagaccccagtgttttatatacatatttttcttttttattttagagatggtggtcttgctatgttgcccaggctggtctcaaactcctgggctcaaacaatcctcccacctcgccctcccaaagtgctgggatcacaggcatgagtcaccgcaccggctgacccccatgttttaaattgtacctgggattttgtttttattcaggtatggcgaggccaacagatcaggagatgattgtcattgaaagacagttggttaaccacagttctcaagaggagggggcatgccatgtcacacagggccacatggggaagtaccagcatcagtcaggaggcagaaggaggaagggggaagtgtgggccagagtcttcattgtgattttggtgggaaggaataggcaaggcagggtagacaagctggatgggtttaggactggctagcttgaacaattcccttgggttctgggctataggggtggtccctagttgtctagtacctaagcaggatgatctagaatgggggatagcatcctgaactgcaggagctgataaaaggaggtaggaggtggatgggggttatggaatcaagattggttggtttgcacattaagaggtgctcccaggcaagattgccatctctaggaattagctatccctaggaggggcagtcccttttcgggtccataaggcccctggatgtcaaagcatcataaaatacagaaaagaaaaaacacgattaataggccaggcgtggtggctcacacctgcaatcccagcacttttggaggctgaggcaggagtatcacttgagcccaggagtttgacacaaacctgagcaacacagtgagactccatctctgccaaaaacaaacaaaaaatttgctgggtgtggtggcgcatgcctgtagtagcagctactcaggaggctggggcgggaggatcacttaagcccaggagttaggggctgccatgagctatgttcgtgccactgcactccagcctgggagaaaaagtgagactctgactcaaaaaataaaaaataaaaacatgatgaatccatccaggaatgggagtaaaacaccttggactttccagtccacactgagccaccagctgactccctcagctgaggcctcaggcatcatagagcagaaggagcagccctgctgtgttctgtccaaatttctgacccacagaatagtgagatacagtcacaataaattgtttcagagcctttaaatttcgaggccgtttgtcatgcaggtgtagatttctggagcccctccaccctccaagactcactcattagcagattccttcccaatctcagaagggacttgggaaagataattccatgattggttaaagacatgactcccatgaccatataatcagcttaattttaactcccattacaaagatgaagaaactgaggttcagggagggaaagtcatttacccaaggtcacacagtgcaaattcaaatccaggtatgccagattccagcatccagccccttccactgtaccagctgtcacctagttggcctctttatggagcccatggttggagctgagagagccttatggatggtctccaaaccaggccccccatgaatctcacccgccccctctccatgtgctccccgtgttttcccattggagaaatcccgcatcgcctctcatcaggagctgggctggaactgctacttccagaccctgggaagcttcgagtgcttcccttccgctggccttccttgcatccatgcagagactgtgccatcttccctgcatcccagcacccccggcttcaggtgtatcaaagtcccagcgctgcgtgaagttcaggtttgaacacatctcagcaggctttgtgaatacattagtttttgttttcccctaacatgccacaggggtgggaggaatgggagggggcactggaatttaatatgcaaatgtatgcagatcgcatctaaatgagggtgtcccaggtttaatgggaagaacaggcaatcagagcaggcccagcccagcctgcagccctggggctctgcagcagcacagtcagaaatgactctccggggagggtgtcttgggctcttttacagagcgtgttctttgaagcaatgtctccgcagcacaggggaaggaagagctgcggaaattggttctggatacttcctggcaaagtgttctcaattgcttcaactatgttgggggtgggtgggagagagggggtagaatctctgaacctctcagtgaacacagccagcagcggctgtccctatcagtgatttctaaaccgaaggagcttgctaacatctacttccagatcacactgattactaaaccagaatctcttgagaacctttgttttttaaaagtccctggctttaggaaatactgacactaaccaggcgttcttaatctggagactcttacaggttccggggcccggtatagcaatgttattaacccttcctgcatattagaatcaccgaggcttaaaaaatttcccaacgctcaggctgtaccctagaccaattaagtcagaatctacaggaggggaggtgaaagtcaggcatcagtattcaagagaaaatcctgagtgattccaatgtgcaatcaaatttgagaagcattgctgaacaggattcccacgagacacttgttatacctgtgcttgctttggggctattgttagctgcaggcccaccacccggtgccagcttcaggagaccctccttctaggaaggggactggaggattggtgtgcagccagtatgcactggtatagcagcattggttgtaaaaatactgaaatatggctgggtgcggtggctcatgcctgtaatcccagtactttgggaagccgaggcagatggatcccttgagctcaagattttgagaccagcctgggcaacatggtaaacccatctctataaaaattgcaaaaactagccaggcgtggtggagcgtgcctgtggtcccaactacttgggaggatcgcctgagcctgggaggcacaggttgcagtgagccgtgattgtgccactgcactccagcttgggcaacagagcaagaccctgtctcaaaaataaaatactgacatatttccccatccacttgtaactggggctgctttgaactttctaagttcaaagcatcaccctccccatctccccagaccctggacataatcagttctgattagttagggctcctgaggacctggttgttaaatacttgaacatcaccccccgctataatgttgtagtgagaagcacccactttatatagtcagaaaggcctagattcccacttgattttggtatgagttgtgtggcttttggacaagtggcttcatctctctgaaggtcagtttcctcatctggaaatggggtcaaatgccctccctatcagcgtagggatgaagctgcactacagcagaggtggcaaactgagcatgcatcagaatcacttggctgggctgggcacagtagctcatgcttgtaattccagcactttgggaggccaaggccagtgtatcacctgaggtcaggagttcgagaccagactggccaacatagtgagaccctgtctctactgaaaatacaaaaattagccagacatggccacaagcacctgtagtcccagttgctcaaaaggctgaagcaggagaattgcttgaacctgggaggtggaggttgcagtgagctgagatcatgccactgccctccagcccgggtgacagaacaagactctgtctcaaaaaaaaaaaaaaaaaaaaaagggccaggtgtggtggctcacgcctgtaatcccaacactttgggaggctgaggcgggcagatcacgaggtcaggagttcaagaccagcctggccaatatggtgaaaccccgtctctactaaaaaatacaaaaattagccgggcatggtggcgggcccctgtagtcccagctactcaagaggctgaggcagaagaatcgcttgaacccgggaggtggaggttgcagtgagtcgagatcgtgccactgcactccagcctgggagacagagtgagactctgtgtcaaaaacaaacaaacaaacaaacaaaaactttggcttgttaggtcaaagatttctgggccccaccccggagttgctgattcaatcattctggggcggggaggatttgtgtttctaagttctcaggtgctgcaggggcttctggtcctgggactacagtttgagaaccattgaactggaagatgtatgagaaagtgggctgggccgagagtagaggctcaacccaggcttggaaaagggtcaaaatatgtgccggtttccctgtgcgccacatggacttctccctcctgagccattccccagggctctctccatccatttgtccagcagggactgagcccccgctgaatgcttaaccttggatttctcaaagattaagtcctcttcccacctcttccccattgtgagcaggaccagatttacacctttagtggctgtgattactgaaaatacggtgcccctcccatctgttgtccaaagtaaaacaacactaaaccctgaaatgacttcataaaaagaacaatagagaactgatttttttttcccaagctggctactttgaggattttttccaaatatcaaaaacaatattttattttatttatttattttgagacacagtctccggagtctcgctctgtcgcccaggttggagtgcagtagcgcgatctcagctcaccgcaacctctgcctcctgggttcaagtgattctcctgcctcagtctcctgagtagctgggattacaggcatgcaccaccatgcccagcttatttttgtgtttttagtagagacggggtttcaccatgttggccaggctggtcttcaactcccgatcataggtgatccaactgcctctgcctcctaaagtgctgggattacaggtgtgagccaccgcacccggtcaaaatcaatattttaaatgtgtattttgggactgcgcctgctttgctgggaccccaagcatattcttacctgccagtgggcaacccagtgtcaaaggaaccggtcccaggcccattctctttcacctccattttcacatctctccctgcacagcaccatcccttcttgtagacaagaacttctcaccttaaataaaactccacttgaggctgggcacggtggcttacgcatgtaatctcagcacttcgggaggccgaggcgggtggactgcttgaggccaggagtttaagactagcctgggcaacgtggcgaaaccctgtctctacaaaaaaacaaaaattagctgagcttgatggagcacacctgtagtcccagatactcagaaggctgaggtcgaaggatggcttgaacccagaggcggaggctgcagtgagcctagatcacatcattgcactccagcctgggtgacagagtgagaccctgactcaaaaaaaaaaccccaaaaaacaaaaaaacctccacttgactgttctctgccctaccagctacctcactcttattttccttttttatctccaacttttctttcctacagatttcagccaaataactcacatctgttccctctgttggttcctaaacataactcctccagcctggcttctgggcaatcacccctccctgcccctagactgctgcccccatggacttcctttttgcgagagccagtgacctgatcttagcacgggattgggagtcagaaggcctaggcagctggtcactcaccagctgtgtgaccgtgagcaacttaaagcacttctctgagccatgggtatgaacgttaatttgcaaagttgagatgagagcattagagtaatagaatcataatagctaaactgtgtgtgtgtgtgtgtgtgtacctgctaagagccaggcactgtgctgagaatttgccatgtataatcacatttaatccccactacaacacctccaaatgaggtctgcttctttccccactttacaaatgagaaaagggaggcacagagaggtaaagtgatttgcctaaagtcccacagcccataaatgataggtagtagaatatgaacccaggaggtctgattccaaaatttatgccctatggcttccttactgacggtgctcagtacagataagtgggaggtgtgacttggtgttaatagggactctaagagtcagtgtgggaattgccattcccctgaagctagggatggcaggtgtgtttgtgggttgggggtggggtacttgagtgatgctctcccctgaggcaatgtcttgcaggatacacacctttctacttcatctcagatttcagtgtctcctccacatcctgccagagcctctctggcctggctgcccctcccctctctggcaggtttgggagaaagaggcttggagttcccccatcctagatagcgggacagattcctcatctcgtgaggctgaccctgatctgggggcctgttattaataatggcctgcagggctgtgtcatccagctagtgattcaggactccagggtcagcaccctccccatcctgatggagctacctcagtgaggggcttagagtctaagctatgactctacgtgagggtatatgctgttctctgcctgcactcccagggtcttggctaaactctattgtggtattaaaaagagaggctgggggaagtggggaaggggatgtggtaaccagaaccacttcctgccactgcagtgttgaaagccaagctctgtccaagttccccttgatgggggttggggagccaggaggtaaaggaggaagttgatgggagttgggggggatgttaaaaaaaggaggattcttatttggattgactccaggaatcaagatctgggtttcctggctgctctctccctgctcccatttggtaaaaaacagcggctgtcctgaaggtggtcctaattagcatagcagtgaacacttattatcatgtgccaggcactttatatttgctaacactttgagccttacaaccaccccatgaaggaagcactattattactccaattttacagatggggaaactgaggcactgaaatgttgtgtcagttgcccttgtcacacagcaagtcagtggcagagctgagatttgaacttaggcagcctggctccagagtgcaggctcttgctctgtgaccactctgagcctcagtttcctcattgcatgatgagggtaattggaatacataaatccactttcctttcttgatgcctgattctctggtaattaattattcattcaatttctccccatgctgaactctcagatccatgaacaatgagacaaaggctatcttggtcactacttgtattcccaattcttagcataatgattggcctagaaaaactcaactagaatgtgttgagtaaatggtctttaaaaggtctgaagatcatcaacaatggtttgagtatctgataaaagttttagaccctttacatagaaaaatcaacatataccagtagctgggggtgagtctgcccctcccactcacccagggtacatttggcaatgtttggtaacatttctggttgtcacaactggcagggggaggtgctactggcatccagtgggtaggggtcagggacgctgctaaacatcctacaatgcacacgacagccccaagtgccaatagtgctaagtttgagctatgtgacatacatacatagatatgtattgtatgtcatgtttggtaccattgatggcaagtggggggtagttaacggattttcctaaaagcccgtgtctgccacccagatgaagatcctccagattggaagatctgttcctctaaactcatattactctatgacctcacattcccgagtctagaatctagttcctcctgggtcccctgtcctagcctctgattccctaaatgcctgggcctcctctcttaccttcagtgggtagcaggggaccagaggagaagcatccaggttttatgtgctgcccctgtcaccgcatccacctacccacttctatacctgggtcatcacagttccctgtaaatggtaataaagatgaaaagcttcagagccaggcagttctgggcttgaacactagttctgtggattaactcgctctgtgatcacaggcaaattccttaactctctgagccttagtttccccctctgaaaacaggagggatactcattaaacttaccttacaggtggtgaggatgaaacgagaggcttatagagaacttattacggtgcttgacacagtaaatctcaaaaaatgcattattattattatggttcagaggtaaagtgacttgcccaaggtcacatagctggaaaatggcagagccgggatggaaatccaggacttcgtgactgcaaagcagatgttcattggttagtgaactttagaacttcaacttttctgtaaaggaagttaattatctccatctcacagtctcatttattagataagcatataaaatgcctggcacatagtaggccctttaaatacagcttattgggccgggcgccatggctcatgcccgtaatcctagcactttgggaggccaggtgggcagatcacttgagtcagaagttcgaaaccagcctggtcaacgtagtgaaaccccatctctactaaaaatacaaaaaatttagccaggcgtggtggcgcacgcctataataccagctactcgggaggctgaggcaggagaattgcttgaacccgggaggcagatgttgcagtgagccgagatcacgccactgcactccagcctgggtgacagagtgatactacaccccccaaaaataaaataaaataaataaatacaactttttgagttgttagcaggtttttcccaaatagggctttgaagaaggtgaatatagaccctgcccgatgccggctggctaggaagaaaggagtgagggaggctgctggtgtgggaggcttgggagggaggcttggcataagtgtgataattggggctggagatttggctgcatggagcagggctggagaactgaaagggctcctatagattattttcccccatatcctgccccaatttgcagttgaagaatcctaagctgacaaaggggaaggcatttactccaggttacactgcagcttagagcccaataacctggtttggtgattccaagttagaatcatggtcttttggcagggtctcgctctgttgcccaggctggagtgcagtgacataatcatggctcactgtatccttgaccttctttctgggctcaagcaatcctcccacctcggcctcccaaagtgctaagattacaggaatgagccaccatacctggccctgaatcttgggtcttggccttagtaattaaaaccaatcaccaccatccgttgcggacttacaacctacagtgttctaaacattttatatgtttgatctcatttaatcctcacatcaatttagggacaaagagccccccaccccccgtttttttttttacagctgaggaaacacttcaaagtggtaagacatttgcccgaggtcctgaaggaagagagtaaagccatgtctgctgttttctagaggctgctactgtcccctttactgccctgaagattcagcctgcggaagacagggggttgccccagtggaattccccagccttgcctagcagagcccattccttccgcccccagatgaagcagggagaggaagctgagtcaaagaaggctgtcagggagggaaaaagaggacagagcctggagtgtggggaggggtttggggaggatatctgacctgggagggggtgttgcaaaaggccaaggatgggccagggggatcattagtttcagaaagaagtctcagggagtcttccatcactttcccttggctgaccactggaggctttcagaccaagggatgggggatccctccagcttcatccccctccctccctttcatacagttcccacaagctctgcagtttgcaaaaccctacccctcccctgagggcctgcggtttcctgcgggtctggggtcttgcctgacttggcagtggagactgcgggcagtggagagaggaggaggtggtgtaagccctttctcatgctggtgctgccacacacacacacacacacacacacacacacacacacacacacacaccctgacccctgagtcagcacttgcctgtcaaggaggggtggggtcacaggagcgcctccttaaagcccccacaacagcagctgcagtcagacacctctgccctcaccatgagcctctggcagcccctggtcctggtgctcctggtgctgggctgctgctttgctgcccccagacagcgccagtccacccttgtgctcttccctggagacctgagaaccaatctcaccgacaggcagctggcagaggtgggcaaacacctagtctagagttggggagggctgtccgtgagggtgttgagtgtcccagagaggatgcagggcctcagaggagatgctttaggggtgtgttggtggtgatgggcgtatctgaagaacagaggtgtccagggttaggcagtggggggtcttgtggaggctttgagcagtgatggccagaaatgggcaatggggctttcctaggtgggaaatgggaaatggtttggggtgggggaggcattggagggttctggggtaagcataggctgggagtgaacaggggcaaaccttatgcagctgtggggtagaaatgggctagaggcatccaggggtgagaaggagctgaggatgtctaaggaggggagatccctgggtggtcagaaagcactggtgtctggaaagcatttaatgctttattaaatgttagtccctgctgggcatgacggctcacacttgtaatcccagcactttgggaggctgaggtggtaggatcgctgaagctcaggagtttgagcccagcctaggcaacatagtaagatcctgtctctacaaaaaaattaaagaaatagccaggcacagtgatgtgcacctgtagttccagctatgcagaaggctgagatgggaggatcgcttgagtccaggaggtccaggctgcagtgggctgataccgtctctccgaaaaagaaaaagaaaaaagactccctccatgagtgtctggagggagtcctttggccccagctgggcagagaaaggggtcagagatctggcatgtgtgtgtcccttcatccacaggaatacctgtaccgctatggttacactcgggtggcagagatgcgtggagagtcgaaatctctggggcctgcgctgctgcttctccagaagcaactgtccctgcccgagaccggtgagctggatagcgccacgctgaaggccatgcgaaccccacggtgcggggtcccagacctgggcagattccaaacctttgagggcgacctcaagtggcaccaccacaacatcacctattggtgagccggggccgtgggggcagcggggtggggcggggaggccaggtctggctcttgggccagcggtgaacatgtcctgtcttggacgcgtccctgggtttcactatttaatgtgtggcccctggggagtgtccccacctctgagcctctgtttctccttcagggaaatggctcttgcaatccaagtcctcctgccagggccattgtgagggtctaagtagacaaaaaaaaaaaaaaaaaaaacagtctggaagcaatttatagatgagagcgtggacggcagagagcattgtgtatgttgaagtctctgcgatatggggtgtccctgctgccccgctccagcctttcacttctgacctccttcctctggctcttacgctacaggatccaaaactactcggaagacttgccgcgggcggtgattgacgacgcctttgcccgcgccttcgcactgtggagcgcggtgacgccgctcaccttcactcgcgtgtacagccgggacgcagacatcgtcatccagtttggtgtcgcgggtgagaacgtgaggagggaaaatccaagagacctgggcggggtcagggaagggaggaccacggagagcgtggaggcagcagtggccccggcttcctcttgcctgcccgcgctgccctggcttatacggcccctcctgccagacagtgcacagggccagggcgccaggctgggagagcttcgcgcaggcgggatttcagcccgcacttatttcggagcccttgccttgggcagcgcacaatctgcgcagcagtactcggctaaccctcttcctctcgacctgtttcttcagagcacggagacgggtatcccttcgacgggaaggacgggctcctggcacacgcctttcctcctggccccggcattcagggagacgcccatttcgacgatgacgagttgtggtccctgggcaagggcgtcggtgagattctgagtcctcctggcccctgattcccttcattctctcccactcatcacccgccgccctaactccggtcccccctcctcctgcagtggttccaactcggtttggaaacgcagatggcgcggcctgccacttccccttcatcttcgagggccgctcctactctgcctgcaccaccgacggtcgctccgacggcttgccctggtgcagtaccacggccaactacgacaccgacgaccggtttggcttctgccccagcgagagtgagtgagggggctcgccgagggctgggggcgcccaccacccttgatggtcctgggttctaattccagctctgccactagtgctgtgtggcctgcaattcaccctcccgcactctgggcccaattttctcatctgagaaatgatgagagatgggatgaactgcagaccatccatgggtcaaagaacaggacacacttgggggttataatgtgctgtctccgccttctccccctttcccacatcctcctcgccccaggactctacacccaggacggcaatgctgatgggaaaccctgccagtttccattcatcttccaaggccaatcctactccgcctgcaccacggacggtcgctccgacggctaccgctggtgcgccaccaccgccaactacgaccgggacaagctcttcggcttctgcccgacccgaggtacctccaccctgtctaccaggttcagccccgccctctcatcatgtattggcccccaaaacgcggctcttccctcccatcagtttgtctttccactctcattggtcctcaggacgaccgtgactccgcccacctacaccacatttccaccactatccctgacttccaatggccccgccccagccactaaggttcggccttttctgcccagctggccgcctcttccttggtctggtgtcccaggcaccgcccacgggtctagcctcttctcaggagtgctctacagcgccccctaggccaccaagattgtttagctccctgtcgggtcggcccctgactccttattggactcatccatctggctcatccaaggccttgggtctctccagctgactcgacggtgatggggggcaactcggcgggggagctgtgcgtcttccccttcactttcctgggtaaggagtactcgacctgtaccagcgagggccgcggagatgggcgcctctggtgcgctaccacctcgaactttgacagcgacaagaagtggggcttctgcccggaccaaggtaggcgtggtcccgcggctccggggctggggttcccggcagtggtggtggtggggtggccagggctgggggctcggcccggcgctcacgtctcaggctccctctccctccaggatacagtttgttcctcgtggcggcgcatgagttcggccacgcgctgggcttagatcattcctcagtgccggaggcgctcatgtaccctatgtaccgcttcactgaggggccccccttgcataaggacgacgtgaatggcatccggcacctctatggtgaggcaggggcagggatgggaggaggaggggaaagggcgtggctgtgccacagtaccaaagaattgggggttggggatcgggggaggaacggggcgtgcaggagaggtgggacctcaacgtctgtctggaagcagagcctgggcccagtcgctgccatgtcagtgcttagaggtggtgataaagagactctagagagagataggtgtgacttcaaaagccagtctactctgggcatggtggctcacgcctctaatcccagggctttgggagacccaaggcgggaggattgcttaagcccaggagttccagaccagcctcggcaacatagccagactcccatctctacaaaaaataaatgagcaaggcgtgaaggcacatgtctgtagtcctagctactctggaggctgaggtgggaggatctcttgagcccaggagttcgaggctgtagtgagctatgattgcaccactgcattccatcctgggccatagaggatgtcgcttaaaacgaaaaagaagaagaagaaagtcctgtggtttgggaagggaggctgagtgaggaggggcctgtgtgccagaggaggcttcactgagaagcttaggggagcagatgttctaggggtacagaggtatgcaggaataggaagagtctcaccccgtgtctctttttaggtcctcgccctgaacctgagccacggcctccaaccaccaccacaccgcagcccacggctcccccgacggtctgccccaccggaccccccactgtccacccctcagagcgccccacagctggccccacaggtcccccctcagctggccccacaggtccccccactgctggcccttctacggccactactgtgcctttgagtccggtggacgatgcctgcaacgtgaacatcttcgacgccatcgcggagattgggaaccagctgtatttgttcaaggatgggtgaggaggcggggttgtgtggatgcgggagggggctttgcggaggggctgcccgtcccttcccgcccactggccctgtgtccaaggcttagagcccgtcctttccctcctcgctttctcaggaagtactggcgattctctgagggcagggggagccggccgcagggccccttccttatcgccgacaagtggcccgcgctgccccgcaagctggactcggtctttgaggagcggctctccaagaagcttttcttcttctctggttagttacctactttccctcccccgcccggtcaatccccatcagtcaaggaggctcaagagaccatcgataacccacgaaacgtcttgtgcgttttagaaaaatacgccccctggcggacgcagtttagcaaacgtaggggcggctgagtttctgccccctcctctccacgccctcgcgtcgctctacccagcgcctctgcccctgggttgcagggactgcgggcacgcgggctaggaaaggcctcgccggaatctccctcctcgcgttctaggagtacgtgctccctctgcgcccccaaaccgacgtgaccctcctcccctgcagggcgccaggtgtgggtgtacacaggcgcgtcggtgctgggcccgaggcgtctggacaagctgggcctgggagccgacgtggcccaggtgaccggggccctccggagtggcagggggaagatgctgctgttcagcgggcggcgcctctggaggtgagcgccgccgcggccgccggcagggggagcccgggcgccgtcggtccgtccgctagccggctcagcacctgtctcctccgcgcctgcccgcaggttcgacgtgaaggcgcagatggtggatccccggagcgccagcgaggtggaccggatgttccccggggtgcctttggacacgcacgacgtcttccagtaccgaggtgagggctgaggaggatcccttcgtgagacaccacactaagctcctcttagtgagtggtcaaattctgagcgaggaagaaaaagcccttggaaatggaaacaaatgccccagcacagacaagatcccagcagaggcagaggccttctccaggtcatttaggaagtcagggatgcaaccaagaccaggacccagatttcctgcctccccggctggaagctctttctccttcagtacaggacggcaggtggtttgtatggaagctcagttattagacaacagtcatcaagtgccgataatgtgccaggcactgtgctacagggagagataagacaattcacagctctgtgactttgggcaagtcactgcttctctactcttcgagcctcagtttccccatctgtaatatggggactatagctggaattacacttgacttccctttcttaccagtcacatccaaacagttgacaaggtgaacaagatttcctgccaccaaaatctttttcgagtctgtcattttttttgccatcttctttataaacaccccagcccaaaccatactggctgtccaggacctttaacaaattccatgagattagagagggggtaggagtgaagggcaatggtcttgggagtgaccccagatgaattccaaggtcaaagaaattaagaggatctgacactccacccccgtgttctcatctcttcccactcctcctgttatttactctgctccacccacactggctgctctttgaacagatcaaggtcattcctagcttacagcctttgtgccagttgttccctctgtctggaaagcttcccctccagattgtcactgggccatcccactgtcttccttcaggtttcagtgctaaggccattgcttcaatgaggccttctttgatgcttattatctatttacttgtttttattttctccatagctttctatattttctttttttttcttttttctttttttttttttttgagatggagtcttgctctgtcgcccaggctggagtg[141 bp omitted]tttcaccatcttggccaggctggtcttgaactcctgacctcgtgatccacccgcctcagcctcccaaagtgctgggattacaggcatgagccaccgcacccagccgctttctatattttcaaaaccaatctcatttatttatgtgtttgcttaattgtctcttgcctcactagagtgtaagcaccaagataattgagatcatgcctgcattttttctgcttatccccagtatcttgaacaaagcacatagtagatgctcagtaaatgatgaatgaacagatttgttcaatgaatgagcgttgaatgaattgttctgagcattaagatagttggtctattcatttgttaattcattcacaaaatgtgtatggtgtacctactgtgtgctaggctctgtggcagtgctttgggcactgaggtctgtgccctccagcatctcacagaacctcacagcatctcacaggttggggggatggaggtgatatgtgaaaaccttagaaagttctagaaatggcagaagagatggttgtcaagatcttgttcctatttctgtatatgtgggagaattagaatcactcctcttatgcctgcctgtctcctgcagagaaagcctatttctgccaggaccgcttctactggcgcgtgagttcccggagtgagttgaaccaggtggaccaagtgggctacgtgacctatgacatcctgcagtgccctgaggactagggctcccgtcctgctttggcagtgccatgtaaatccccactgggaccaaccctggggaaggagccagtttgccggatacaaactggtattctgttctggaggaaagggaggagtggaggtgggctgggccctctcttctcacctttgttttttgttggagtgtttctaataaacttggattctctaacctttagaagcagactttatttatatatgtatgcacgtatgtatgcatgtatgtatttaactgatagagtgcaaaaaaaaaaaaaaaaaggaaaaacaaataactgatagagtgctttctacgtgccagaaagtgttctaggccgggcacggtagctcactcctagcactttgggaggccgaggcaggcggatcacgaggtcaggagattgagaccaccctggctaacacgatgaaaccctgtctctac[133 bp omitted]cactccagcctgggaggtggagcttgcagtgagccgagatcacgccactgcactccagcctgggtgactgagcaagactccgtctcaaaaaaaaaaaaaatagtgttctaggcactttgtaaatgttaacatattcaatcattcctgttaggaaagtatgatgtgattatttctattttacagtcaaggaaatgatcaacctgtttattcattcatcaaacatttattgagcccctacatggagccaggccctgtactgggcaatggggatagagaaatgagttagactttagaatgcataagattccccttggaacttgcttaaaatgcaactccaggctccacctccagagagtctgacctatttacaagggtgattctatggctggtggcggtgggatcacacttggggagtgtgcagtgcatgatcttttattctacaataatggtgtgtgtgtgtgcacatgtgtgtgtgtctgtgttgtggttgaggtccaggaacgtttctcagtcaagatgacatctgaaccggaactgaatcagaaaggatgaacgagcttcttcctgtgcaagggacaatcttcttacagggtaatttaccaagaaccactaaacctaaaaatgtaactactttctgaccctcacatgtgtgcacaagacaacacatagaaggatgttgattgcagcattgtttgttagtgaaaaactggcaataacctagctgcccaggagtaagtcagtggataaataaaatatggatcatatacctgacgttagtagctatccacggtacagcactatgtgccaggcactgttctatgtgcattttgtgtgacaaaacaaccagaggagataggtactcctattactttgtatgtactattattactgccatcaccaatcccttgttttacagataaggaaactaaggcacagagagttatacaactcacccaaagtctcatagctagtgagtgataagagtgggatttgaatgtgggttcttggtgcaagtgcacgaagagaaaaagaagagaaaaagcagtgggtgtctggagaacttcaaatggctcagaactccagcatggggtagtagcaggtggctaagagggaatggagaggattccagaatggttaagatagcagtgctagtttgggctagatgagagaagtcctgaatgccaagctgaatatgaatttgaccttacaggttagcaaagggacttgactgaaagattggggcccgtgagtggagatgatgggtttgatcagggcccacgtgggaatttaagtaggagtccagaaaactgccctcctgagcttcctctttcatctgtttcttgctcaaatgacccactcccacttggcgtacaaacattccccgccatggcttgtttacaatctgtcttaacccctgcctcccactagatactagtctatttctctaccttcctatccctattcacaataaaacttcccaaaagcatggtctctactcactgtctccacttcctcaattcccattctctcctcagccatttccagcctggctcccaccccactacaccaccaaagtcaccctcttcaaagccatttatgaccttcttgtagccagatgtgacaggagctcctctctgctcatcccacaccaactctccccacattgacacagtggatcctgcccttcttcctgaaactctcggcctctggaaccttacttctgggtctcctcctacctcactgggtggattttcctcttctggtgacagaggcacccttgtgctcaatcgtgggaatcctctgctctgtgtatactcattccctgtgatgtctggtagcccacagccttaaatagcatctctctgctaaagaccgtgaaatttatgtttcctaccataacctcctctcccctgccccgagctccagactcatgttcaactgcctactctacatggctccttagctggcaaacagacctctcaacctaacgggtccaaactgactcctgggtttcaccttccaaacgtgctcctctgttgttaccactttaataagagacagcatcatccaccctcaatcaaactgaacacctaatcagtcctaaaatctaggaatcagttatttaaacttcttttctagtactgggtttctcagcctctacactattgacattttgggctggatactttgttgtgggggattgtcttacactgtacatctacactgtaccttctagcatgtttggtgtcttcctctaggaggtgacaggatccacggccagatgccaggcccattcagggtcagccctctctgctaaggaaggccccagtgtggggatggggtgcagcagggtaatgttgaactgtgactcatggccaggcagccctggtacaaacctagagggcccaagaggcctttagcccctagatgctggtactagcccctgctccagttgtgataaccaaaaatgtctctgaatattgccaaacattccctggtggtcaacattgctcccagttgagaaccattgccataatataataaatatacaaatgtatctatcataagtgtacatttgaagacattttcacaaatggaacacaagtgtgtaaccagcaccaggtcaagaaacaagaggctgggcatggtggctcatgcctataatcccagcactttggaaggccaaggcaggtggatcatctgagatcaggagttcaaaaccagcctggccaacatggtgaataactctctccactaaaaatacaaaaattagctgggcacggtcgtgggtaccttgtaatcccagctacttgggaggctgaggtaggagaatttcttgaactgggaggtggaggttgcagtgagccaagatcatgacactgtactctggcctgggcgacagagtgagattctgtctcaagagacaaaaaaaaaaaaaaaaaaaaagaaagaaacaaaacattatcagcaccctagaagcctgcttgcaatcactacctcttctccccaaggggtaccactatcattacttttttttttttctgtcacccaggctggagtgcagtcgcatgatctctgctcactgcaacctccgcctcccaggttcaagcaattctctgcctcagtctcccaaatacctaggattacaggcacccaccactacacatggttaatttttgtatttttagtagagatggggtttcaccatcttggccaggctggtcttgaactcgtgacctcatgatccaccagccttggcctcccaaagtgctgggattacaggtgtgagccaccgcgcccagtgccactatcattacttctaacagcttagatagactttgactattttttactgtatttaaatagtgttatagggtatgtattcttttgtgtctggactcttttttatcaaggttctatttgtgagattcatccatattgttctgagaattgtagatggtattccattgtgtgaaggtactacgacttatttctctattttactgttgacaagcatttggtagattccaatttggggctattatgaacaatgcccctatgaacattcatggtaaatgtcttttggtgatcacaagtagtcatttctttcgggtatatacctaggagaaaaactgctgggttgaaggatatgtgtacgttcaccttcagtagatgtttccaaatagtttcccaaagtagtttttgcctaactacactcccaccagcagtgtgtgaattgccaggatttctccttgacttcactcttatggtcacgtgtcacatccgatccatcagtgggtcctgatggtttcactttcaaaacctaactggaatcagacaactgccaccactctagtctggctgtcatcaccccccagcttggggtctgcaggagcctcctaattagatttccagcttctactcttgccattctttagttgaaccttcgcccagcagccagaatgatcctgttaaattataaattggatcacatcattcccctgctcaaaaaatccaggatcctccccaaagccttcagaagaccacatgatctgcccttctctcctccctcatctccagtcactctcttctccactcactctcttccagacacaatggccttgctgtttcttggacagtcgggactccttctcactccaaggctctgcatttgctgtttcttcttctagagaactcttccccctagatctttgcatagctggcccttctcatcagtgaggtctcagctcaaataccacatcttctaggaggccttctcaggccacccctaaagtagtcctccctcttacccattatcccatggccctagttttaaacatacatccaatctcaaatgatctcatctatgcatttgctcacttataatctttttctccttattagaatttaagccacttgagggcaagaagccagtggatctcatccaccgacgtatccctcgcaccattgaccgaaacacaggagcgctatcgacatgtgccgaatgaatgaatgaatgaatgaatgagccccaggtgtttaggagaccctaacagaggtgcccccgttgtagggacgactctcacctgcagatggcctcctcaggcccttcgggtggcactggggagcccagggcctcccagcgaagtggccagattcaggaacccttcgcacagcgggcactaggaccctgcgcggcgccgcgtctcgcggggggcgggcgggcggagggggttgggggatccgctctttctccctcctagagcctggttgcagccacttgtgcgatcccggaccttgccgcggccgcctggctcctttccgcgccatgagccgcaggttcacggtcacctcgctgccccccgcagggcccgccagaagccctgacccagagtcccgccggcattcggtcgcagacccccgccacctcccgggggaagacgtcaaaggtagaggccgcagggggcggggcctgccagggccgggcgggacgagggggaggggccggggcggaccgtctgttgaagggggcagggccaagaccgggggcggggaggggtcccagccctaggcctgagaggggaatggagccaggactaggaaaccaaggggccggggccgcggaacgcaaagtgtggagggggaggggccaaacgcgaggtgggcgtggccacgagggaaaggggtggggccagggaaggggtttggacggaggcgaagggggcgggtctggtgatggaaaggccggggtcaaggtggagagtaggccgtagggcactaaaggggcggggacatctcgagtagggagcgggaccagagtgaggaggtggaactagggaaaaagggggctgtgtgttgaagggggatggtcaggagcccctaaaggggaggcggcgggactaggttggtttggggtcaggaaagggcgggactagtagggaatgagttgggccaggaggatgggagtggggcctgggaggggggtggggtcgagggcgggaggaaaactgagtcagggttgccgaggcaggtgccaggtcagcgggtcctcggtgcctggcggatcctccaatcctctagctccctggaggcttagcggacagcgactggggatcccgggaaggagacgggaggcagggaagttagtatggatcctgggcagcgagattcagggaggatgccgtagggtcgctgatcccgactcttggggacccacttagctccttgtctgctcgagctccgtaagggttgggaggagccagctcaggcggggttgggggcgtcttcctcgcgggccctgtgcagggtcttgtaatggaagttacacgcagggcacagagtataggggaggggaaagatccttctggccttcggtggagaagtagcatcctgggcgcgtgcacagtctcccctcagggggcactcatcaggggtcctctccctggctctgaggccctcgggtctggaaggaacaaggcgaatcggcttgtagtggccccagcgaggggaggaggaggaggaggaggaggaggaggaggaagaggaggaggaggaagaggaggaggaagaggaggaggaggagaaggaggaggagaagcctccccagaccgccaggggtcgctgccgagccgcaggtgagctcgccccgaagcaaacccaagcgccgaaacccctagagtaacccttagggggttatctggcggacctcctcattgtacagatgaccaaattgaggcctggaattccgaatggccccagtcccgggaaccgaacgcctcctggttgtggccacttggatttcttgggctccttccactcttcatctttctcataatctcttttctcattttcatgaatgaccttaccagcctcccagatttgaaagtaagaaattctggagccattctcaacccttccttttttctttccagcaaatccaactgatccccacgtcttggccattcacctctgaaacttatcctgaatctggcagcatcggtcccccctctgtcatcatcgccctgctccaagcctcacatggccacgaccacatcctctccactggcctccctgcctccagtccttccctagccctcctccacagaagccccccatcacttgcaaaataaaggccaaagccttaagtctgtcattctctttcctcatttgcttctggtgttcttgtccacattcattctcccacctccatcagccaggaaaactcctattcgttctgtaagttatagctcatttaaccttttccaaaaaccttttcagtttcctcttcggcccacccactgcacccttagtgcacatgtcccggtggatggcagtcgttttctttacttatgggtatcctccattggaacatctcaaggacagggaccatctcctttatctttgtgttctgagttccagacccagagcctggcacttagtaggtgtgtaatgctcataagatgagaggagggtggctgtgggatcctgcttctctacccttgccttctcttctctcgctcctcatcccctggcttaggaataagacggccctctctcatgtcccaaggtgattgctgttttcccattcacactctcagatgccggtactcacactacttcgctggggtcgaagtgaaacacagcccccaagctttgggtgtgcaggtgtgtatgagcctggaatgctgtgtgctgtggcagaggctgtgtgtgtgtgtgtgtgtgtgtgtgtgtcttgtgggaggagcatcccccattagttttgatgacctgtggggtggtcagtgactcactcagtgcttctgtgtgtcactatattgccagcacgttgaagggtgtgctgatgtgtacatttctgtgtctatctgaggggtgggtacctgtgtgcaggagtgtattggaagttccatctggacaatgatttgggtgacttttaaccttttaagcctgaagcagtctcaagcacctcctctctggcagatcactgtatggggaagtagacaagggctacttaggggaacccagcatctgctggtatctttcccatagctgttcttgtgtcagccctctagcccctgatagattctctttccacctcttgtcttcacccaaagggagggatagcagcatgtctaagactgggaaaggttgggggagatggtgtgggtgtgtattatcttttactctgggccaaatgagtggggtttgccacttggggggctttctgctgccagaggatgagccataggtgagaacatgacttacagggagttaaagaagcaaggcaaggccaagcctcaaatctgccactaaccctggattgcgggccacacacctcacttgcttcacctgtgtcatgggagattgatggtgacttggatgaacagaagtagacctggtgacagttgttacaactctgagatgctcccctattcctttatctgatcctctactatgcctccatttctcaggggggagtcagggccctgaaaagagccctgggcctggtaggactaacaggagttgggatgtgtccccatggagggagagggagctaacttatgctgggaggatggagcaagaccacaatgtagcccatctgtgttctagctcaggctctgtggtgtgaccttgggcacacttcttcccctctctgggccttaatatacccatctgtagtataaaggagttgaacaggaagctatctaagggtccttctaaccataaaaatgctaagattttgtgatgatttggaaggatgaagctgtctgccttctctagacacaaacctcatgtttcagtctctccatctgtaaattgggaagaataatgctgttattggtatatatgttggatctggagatttccagtctgtctaaggagatctccagtcatctcatccccaagccagaactcagaacctcactgcccggtacctcagcccaaggtgagccctaggaatctccatggcaacaaactggttatgaacggggctgcagttgccatggtgacaggctgctctctctttctctctcatccccctcctctcccctccccttttctcaatgaaccagagcgatctttaggcctcagttctccaggtggggtggggatcggggggtgagtgcagtgagaaaggggtccggattgggaaagagggaagatggactgagtctgcagaggaatgaggggctgttggggtgctgttgctatggtgatggggctgcagcctgttaattaaacccccggttgccacggagacagtggtggttgacgtgctccgcagtgagccctgtgtgtgtggggcgtgctttgcgctggactcatcaattcactgctacagttttgggtccgaggatggggcatgcgggtggggaagaagaagagtgaaggagggcattcaggaccctgggcccataaggccacagccagcggtgggtgggttaggttgtgggggtaatgcagtggagatgcggagggagagggattgagccataaggaggaatgctatgcctgcctcctgtgaaaagaggacccagtccggtggctctagcttcctccaaccagccccttgtcctggttcagtggatggagtcccggacaggaggtcaaggggctgggttctagtccctagtctgttacaagttcaccccatgaagaaaatatgaacctttccattttcagactccaatttcacaataagtggagagtggaaaataatttataatatctcttccagttcccaaatcctgacactcaggaggcagcttctctgagcttttttctctctgagacatatggtgggagggggtatgagtttgagagactcagagtttagaaataggaccctccctagccctgcatcttgtgctgctttagtgagagggtttctctggccccagatctccccagggttcttggtggggaggggatgctgtactggcagccaggttcctggggctctgagctgtgggtcactttttactggccagtgccaggctggcagtgtggtgggtgcctgccatgtgttttctctgaacctcaccacagagagttggctggaggccagaatagggcacagtcttcctgagaggtgaggggtgtcagtggaggggctggggtccccccttgggactgtctgctcacttggtcggggctccttaggaagggatatgtggctttggtctgagattaatagagcactaagagttttcagagcaggaagaagtgccatggattatacgacctaactcatttttacagacgggatactgaggcccacagagaggaacctgattttgcccagagatacacagagaatttgggggcagaggatatgacagaaccactatctcctgaatctcagatggctcttgagatgggaactctagtgaaggtggacagatgggttccccagggaaagaggaatcactcctgccttcacccgtactccctagaatctaggtttccccatgcatgggcttagtctctgagtggccaaagctggaccacaaatgaaggaaaataaccccaggggaacatgccagacctaggattactgaaaaaccttagcatctccttcattctacagcacttctctgacaaacatgctacacgtgttttactgttatgcatctctgcagagtagtagaacacagtgctgctgctgctgctagtgctgtgtgtgtgtagagtggagtggcatgcttaaaaatttttgaacactggcttcttttaacctctgtcaccaattcaaactcatctcacccttttggtggtttttttctctgggagagccaagaataccagtgcccacaacttgtctgaatagctaactctccaccctgaaaggtcctttgggtatccaaaaaaccaagtggcagcgatacttgattggtaggtccctcagaggcacttttgagtcagctgctgaaaactccacggttgacccaatctgaagccactgacaaattgtattaatacaagtaaagctgagccctggatcctgtccatggtcctgaaaaaagtcctgtcctataccccggtctccagggatatgaatggctctttaggatttttgcaggttttctggaggcttccccttcagttgcaagccaagagtccattctagccctgcacctctgaagcctgagcacaagaaaaggaataaagcacatctcagatgtagtgcctgtttgtttgtttgtttgtttgtttgtttttcaggagctaataatcagaggctgctgaggggcatggatatgactgcatccttgtctcttctatggaggcaagacgacttttataagttctatcaatgaagagagtcctaaactggagtaaagcaaactggatgctagaccaaattctgccatccactggcattatgtccacaggcagtcattttccctctatgggccttagttttttcatctgtgaaatgaaagctgtgtgtaagatacaatgactgatcttttcccaaccgaagaacttttctggaacttagagagccagggagagagctagtaccagtgtgaagattgtttaccccgatctgctcccaccctcagatgtttagatcttctagagactcaaagctttcaaacctctgatgccacttcctgagatgtctgcaccactggctcaaacctggactctaggggctctgaggggtcccaggatgatcaagcttctgggggattggcctaagggaagaggggaggaggacagagagcatgtcggctctggaagcctcagaaagcaatcctggattaggggattagacacttctgccccaggagaaaatctggtctcaaaccgacaggcggcctcattccgccctcccccactctgtccctggccagcctcaggaccggcctgtcctccctagaggctgcaccatccctgatggaaagtcagtgctccctggaaactcactgctgcctcttctgctcctcctcaccaggtcttatctctagatcagtccgcagtcagaaggtccctggctgtgggctccagggacttgtcttgggggtgggacgctgggactcttgtcagtctaagcacaatgagagagttccttggaacttctcaggcgctaccccacccattttaagacagattgggtcagtcagcccagtgacctgaacgcccctgggggtagcacattgcttaattatgggccctgggctctacatgcctccagctccaatctcttgagcagtggtatgaaagagggtctggttctcctcccccacttcagggctggcctctccagtcttgcagagaggcttcccaagggccccatgttccatggcgcacctccacggccacttcagtgccctttatcttccccctgggggttaccccagacccccagtcaagcagccgctgcggggccgcctccccgcggccgcgacctagttccctgccgttatttttagggcgcgggatggcacctgcccacgtgccgggccccgcccggagagtgggtggggggagctgcgtctgctcaagggaggcgaggccctgtcccccgaagcacccccttcatcccacccacgcaatcccccagtttttgtgcaagggggccactagtcgggctctgcccgcccctcatcttctcttctctctccctcccgctctccccccaaaaccccgccagtggctcacgcctcctgcatacgggatgaggtgagcagcgccgctgctgagagggggcgcgcgcgggtgtgagcgtgtgtccgtgtgcgagtgtgtgtgcgccgggcgggcgggcactgcagcttcttcctccgtggagcggagagcgagacagagctacagcgaacgagagagcggcgaaggcgggtagaggggcgcgggcgaggcggcgcagccatccccggaccaggggccgcgccgccaccatgctaaacaacctgacggactgcgaggacggcgatgggggagccaacccgggtaagctgtggtccgggggcggcgggggagggggcagcgaggagaggaggcagctctggggttagaggcggagcgggggccacctccttcagagaggaggctgggactgacccgggcggtgggcgccagttgcagcctggagctcagctccattggaatgctccgggcgctgtccaaggtgctggaatgcgccgcgcccgggggcagagctgcgggccgggggattatcgctgcccacggcttcgggctgacttgggttagctaaaccgaggaggcggtgggaaggggatagaagacctagaatgggctgatgtggagctcgacggcgggaggagggctcctttccccgacaggggaccccggcgtcctggcgcagagcaggcacccgtggagccggggggcgcagtctgctgcagtccctcgttctaagacttccatctggaagatgggggaagaggtggctgtgtgtgtgtgtgtgtgtgtgtgtgtgtgtgcgcgcgcgtgcgtatgtgtgtgtgtgcgtgtgtgtgtgtgtgtgtgtgtgtagggggtttggagccatatgacagccccccgtccgggctgtggtgtctccttaagacacccagattgtccccttggtgcaatctgggacccctcccccaaggcttcccaaggtccgacctcagactgaagcgtacttcctccatagattttcagctctactttgcagaatctctctctcgctttcccgtgggttcctattcaggacgggaagcaagatcaccctcctttcttccctctttccccctcctctcagttccctggggcggtccagggcggggcgggggggagtctttttagttagctctgctagcttccccagtgaggcctcagaaatggggtcccagtggctgattcctcagcgccgcgacgcggacactgcggacgcgctgcggtgggtgcggagactcgcaaggagccgaggggcttgggacaagtcctttcgctgctcccgctctcccccgccctcctccgcggcttccttgctccgaggtcttggggccagccaccccctcaggctcccaggccccccgccgcccccgagcggtctcagccatccatcacggctgtcagccacccccaccccccactctccagcggcgctgcgtcccctgcgcactagcgcgcctcccgcgcctgctgtctgcgctcagcgccttcaaacgttcccctgggcactgcttgaccctatgagcctagactcccgcagatccctctggcggatggcgcctagggctgaaagagcagggtcttctagggattggcaaccttgactctgaggtcctccggatcctggatctcagggccaagtggccgcttggaaaggctggggacaccagggtccctgatcctttgtctgactcccccccaccccccgccgcttcccgcaactcctcattcctcctgggggctgagtggtatacaggtgccagaactcctagctggccctctcatccacctccccagtgaccctgggatcacctcatccagcatccgccccctcccccgcgggcttctggccggagggggagggggtttggcaaagttgagtctgcggcagcgccaggcatcccgacgcggatctttccatccgggatccccttcagatgcctccactctgagagggggactcagatggagagcatctctctgttccctcagacaccaggtatggtcccatttcccagcacccgctttctctgccaaggtttcaccaggccttggggtttccacaggggctcaggaggcctagaaaagaggcatcagtgtgtgtgaggcaagagttgaactaggaactcgcttcagttctatcccctctccgttagtttctagacactgagtgcagcggacccatctggagaccttctttctatacatagggtccaggacctggaactcaaatggccagaacctgggtcatgtgctgtgggtcccagagagagaagtcccccctcctccaagcggtgcttggagatggtagtaggaggtgctaaggaccttctgggcttgagagaggaccatcaggccaagagcccctgacatctctgattctagattcttggggatgtacgggaaggaactggttgctgacctcgggcaggtggggatgacccgagcaagagggcacttctggactaaagaagagcccagggatgtgtcccggtcttctttctccttggggtctgacgccccgtctccctctcggacctggcctagggattcccccaggcccagccccaggccccggggaggcttcttagcctgcgccgctcgcctgtttcctccccgggagctctggccgccgcagcttaattgaaagccgattcgggttgagagctcccagggggcgggggcggggagggctcagcctcagtctggccctgcctctcgcgcgcgcgccgctcggcgctcccgccatcacccttactccttggctccggggaatcagggcgagtttccccttagctgttctggtcctttgagaactcggaagctcattccccatccccctcaaccagtgcgcctggcgttcagggaggggacgaaatcagccctggctgacaagtcccgggagcctggcgtcccgcccaggcagctactggaaaggcgggacccagaactagcctacctagccgccctctcccctgccctcatctcctggcccggatccggcctggagtctggctccgcgctgcgcgccgcgttacataagcggctgcgggcgcgcggccggctaggctcggcgctgcgctctcggcctgcgcggtcgccatggagaccggcgcggggccacctagttgcagggtctcgggccaggaagcccctattcctgtcccctgagcgccacccgcccccgcgaaggaggaggcgcttgggagggggtgtgaaaggcagaggggaggggttctcctgtctggttgtcctggccctaagaggggatgctgcggggaaatggacccagctccataggagacaggaccccaaaatcttgcggctggatatgcggctggagatgtgggatggggagccccggctgggtgggcaccaagtatgttaataataatcgcaattgtaatgatagcaatagccacactcgtggcgggcacacctaatatgcatgatttaatttaatcctagcaacagccctatgagttaagcttggttagtatccctttgcaaaggaggaaactgaggcgtagagaatttgtgacttgctgaaagtgacgacacagccagtgaagctgggactggaatgtcagtttccataactccagcccccttttttaaccgttaggaaacatcctttcacctcaggtcccctcagtctctagtccacaccatgatgtgctgagaacaggaggcatactatcagcattttaaaaggacctcttccttgtttctcctgttctctggccccagagagctcttctgagaccctggggtccagaagggagccctggagaacttagctccaaagacttttcctgagcacctattatgtgctgggaggtgggtctcttattcccaggaactcacatatgtgagaagaaagagctgacgattgcaccctatttgacaaccgggagtttctgccttgatggatgaggtggaggtggtggcagaagactgggtggtgggtttctttggagcaggcgaggcatcactcctcctggcccaatttttagtcaggaagagattggttttataacagagacaggccatgctctggctgggtgactgaggaaggtttcccggaggtagagaggaggatggggaagacgcagacggatggagatggggagaaagggatgtcagccatcgaggggacaggagaatctaggtgcctagggcctcaatttcacttggaatttgatcagcggggagtttctccagtgtccagagagatgtcaactgctggaattcagccccggaattgaggaagggtcatggctgaagccaaggaaatgtacctatggggcctcttatatctttctgaagggaccttcccccctggtgcccaagatactttctcctcgagtgatctcatctaggcacatggcttcacacgcatactacacatgtttacatagcttacccccatctctttctcctgcctagcctctttgctgcatgtatcctgattcgtatatccaggtggcttctgcatgtatccacttgagtgccctacagtgcctcaccctcagctaaattcagcatcttccccacctccaaactccttctcttctagtcttcccatttatcaaatagcaccatcatccaaccattcacccatgctagaaaccgcagacattatcctaggttcttcctctccccctccccaaacatctggcatggaaatatgccaataattctgtctgttgctctacattgctctggtcaggcacatcatcagcccttacctgggttactgaaagtctctaactacggtactctgttttcttcacctaaaagccagagtgatggctctaaaacatgggtttattcatggtattttttttttgcctgaaactcttcaatgactccccattgccctctggatgaggtccacattcttgaacacgacctgctaatcatttaagggaccagcctgcgcttcccttcccaggctcaccttttcacttttcactgccccttccacagactccagccagatcatacttcattcctctaacccactctattcactgtcacctctgggccattgaacatgctgttctgctattctgtctgcctggaacaccctcccttcctccctcccaggctagctcttactcattcttcagctctcagcggacacgtcacttcctctgggaagactcccatgacctcccaatctgggctggatgcctctcctgtgtcccagtcccttgatcttctatcctagaattgaccatgccagattggaaattcctggctactggtttgtctccctgcacttgggttgctttcctgagaacaaggatgatgtcttctgtgtcttaccctgcttcccccatgcctgtattggcacacggtagacacttggtaaacacattgtgaatgaagatgaataaagggcataggagatgtcagagggggtcacttcttcaagaagtggcacatccttggggccttgatctgtagtgctcctggaaggcagaccttctccactgggaaagaacatgcctccaccccaaacaccggtatgagcccagctatagttaagaaggaaactctggagagtcttggggtgtcctggtaaatggaataggacccccaagagcaaggaagcactcacacatctgttaatacgcagtgcataccagctagtgcattaggctctgtatacatgctgtcaactgcaaccctgcaaggaaggtggtattagccccattttcccaatgcgcgaactgagattcagagggctactgtggctacaccactgtatgcccaggtggttggacaacaactgattggttccagatccctgacccctctcccttctcaggtgatggcaaccccaaggaaagcagtcccttcatcaacagcaccgacacagagaagggaaaggagtatgatggcaagaacatggccttgtttgaggtgggctgctagggctgttgggcccccacctacaattcattatcctgattcatcagctgctctctccctccctccctagggagcaataccctcgtctccacccctcccttgagtctaccttcttccttgagcctccccatccctccttctccctcctgggatttactccctctgctccctgccctctcctcatcctaccattcttacccctgttctcctcacctgttcctcctcctttcccatctcatcccaacctgaatagtttcgtgctccttgtccccatctcttcctctgcccttcgccacccagctcactccacttgctcccccagcctcctagcactgacaccctccctccataggaggagatggacaccagccctatggtgtcctccttgctcagtggcctggccaactacaccaacctgccccagggaagtagggagcatgaagaggcagaaaacaatgagggtggaaaaaagaagccggtgcaggtgaggacctcgggggatgagaaatggaagaaaagggacggatggggggtgggggaggatgggggaggaaaatggatttgaatggagggagggaaaggggatacaaatcagaaagaagagggatgaagggttgagaatagagagaagaggaaggtgggggcagagaaacatggaggaggagcacacctggggtgttcgtaatgatgaggactgcagagactgatgctggcctccctggcaggccccacgcatgggcaccttcatgggcgtgtacctgccgtgcctgcagaacatctttggcgtcatcctcttcctgcggctcacctgggtggtgggcattgcaggcatcatggagtccttctgcatggtgttcatctgctgctcctgtgtgagtgacacccctcccctcaccaccccctgacagctggggcttggcagaggcctgggggtgggaggtgggaggatggaagcatgagacctgagctttttataggaaccactgcttatgatctttgagagtaaattaggcctgactggtccttcctgcatctcacaggcttgtccttgatggctgttaaccaggtttcacctggatctctctgtgtgtaattacacaagtgatgcagctcattgatggaaatgataagggtagggaagaaaataaaattcacctataatcttacaatagttaacattttggcaggtccagactcacaaaaatgagattacatgtcacaaacagcattgtaaccaaattcttcccattctctctaaaaaaatcaaatattcgccaaacacctacttcttgatatatttacatgtcctcgtacataaccttgagacagctctgcatgtgaggtacgcagtgtcggagctgttactcctattctatagatggagaaactgaggcttggagaagtgaagtgagttgtctcaggtcaggcagctggtctgagaccaggctgggatttccagagctctctgatgctgtggcttgcttgggctccttccgttcgcatggtgaataaggttttcttgagaagaaggacttggcaggagtagaagttggaacaggtccagggagcagctcagcagaagagaacctgtgggtttggctggtgtttatggggtataaggcttggcccccacccaggccactgcggcccctaccccagccaccgctctgatgatctctttcctcacagacgatgctcacggccatctccatgagtgcaattgcaacgaatggtgttgtgcctggtaggtgactggggctttgtggggagggaggatggctgggtggaaggagggatagtgccctgggctttgggggacatcaaggcccaagagagataatattctagactagggggctgggctgtatctgttttcagccctattgggggcagaggaggaggcagctctcggtgttgaatagggcagccctcccccaactcatcctgagaccctcctctccaccatccaattttctgagccatgacctccttaaaggggtaattagcaacatggtaattagtgctgcaaaatccatgcagagtggttgcttgggtctctcaccagtcccctttctagggctgcagcccataagcctgtgaggcctggagcaacccccttctgcctctgtcactgaacacccctcaccccttacggcagcccagtgcccccgaccctctcgctgataccagattctccctgcagctggtggctcctactacatgatttccaggtctctgggcccagagtttgggggtgccgtgggcctctgcttctacctgggcactacctttgcaggagccatgtacatcctgggcaccatcgaaatcctgctggtaagagaggctgaggaggaggtgtggaaccccaggttgtcagtcagttaatcagtgctccctggacacctcctataggccaggccattcagtgaggccaaaaatgtggttcagtaaggccaaagtcagatgtggttctgtttctaaagagttcacagtctagttggggagacaagatacaataattatgtaacatacacagctgtcgtttatcaggcccccactgagctctcagcatccttccaagtgctttccagccattctcttgtatccttacgaggtttaagtattatgatgcccattttacaaatgagaagctcagagaggtgagataacttcctcaaggtcactcagctctcagataggcggcagaggtgggttgatgagttaaaatatggtagaaataaaaacagtaatgttatgcagcagctaccattgtgtgattgcctcccaaggggcatggactgtgctaggtactctatgatgttaatggtagatggctggtggctattggattgcaaaagagaagaaccaggggagggatccgtataaagacatctgttgggaatagtgactgatggagagaaaccaggttgctgggcagtgcttgaagtcaggactggtgacttaggtctccatccttcatccccttcctgtagggcatgggtgctgaagaggtgtccctggtggataggaagtagagctgacatgtcccaagcccctactctgtgcaggccccaaggcttgaagtatatcattttattttatcgtcatgactctctcatgagttaaaggtggccattttattttattttattttttatttcttttgagacagagtctcactctgttgcccaggctggagggcagtggtgcagtcactgacagcctcgacttcccaggttcaaatgatcccccccaccagttcagcctcccaagtagctggtaagcaccaccatgcccagctaatttttgtatttttttgtagataggggtctcactatgttgctcaggctggtctcaaactcctgagtttaaaatgatcctcccacctcagcctcccaaagtgttgggatgacaggcgtgagccactgcacctggctaaaaggtggccattttacagatgaggaaagcaaggctcagagtttaaggaacgaatggaaggaatatgaaccttggtctttctgacttccagagccttacacaagtgatgcagcttcattgatgaaaatgataagggtagagaagaaaataaaattcacctataatcttacaatagttaacatatggtaggtccagactcacaaaaaatgagattacatgtcacaaacagcattgtaactgaattcttcccattctctctaaaaaatcaaatattcaccaaacgcctacttcttgatacatttacgtgtcctctataccacactgccttggaaacctagaactagaaggtgtcacagcaattagtgtcacggcaggatggaagagggtaggacagggaggatggatggggcatgaaaggcctgaggaggcaaatgatgagggagaatagacctccatgacttctaaaaattaaaatatttgaaaattgttgtaaatgcaattctgcccattgcagaaaattgggggaatatccaagtcatgaaaaaatgtaaagaaggaaataagtcacccaaagaaaataaccattaacattttggtgtattgccttctagtttttgtttttctatgtggtattgtattctgtctatgtaaaatataaccctatacctaagcaactcatattctctttgtatatattatttgcagtgaaaataactcttggaagaatgtaaacgttaatatttagcatgggaattttagaaaatacagatgtgcataaagaatagattatccacattttttacgattcagggaaaactactgacaacattttgatgtacttatgaaaacacatacagacgtatactaatatacgtatatatcttcacatacacatttataaaaatgagataatgagacatattctttttcaaaaacctgattgtgttcacctaatgtaccatggatagcttttaaagtcagtccatataaatctatgtcatctggccgggcacagtggctcatgcctgtaatcccagaactttgggaggccgaggcagttggatcacctgaggtcaggagttcgagaccagcctgactgatacggtgaaaccccgtctctactaaaaatacaaaaattagccaggggtggtggtgggcacctctaatcccagctactcgggaggctgaggcaggagaatcacttgaacccaggaggtggaggttgcagtgagccaagatcgtgccactgcactccagcctgggcaacaagaacaaaactttatttcaaaaaaaaaacaaaaaaaccaccaccacaataaaaaaccaacaacaacaataaaaaaccaactacatcatcttttttaatagctccatagtctgtggggatatcatgatttattcacccaacctcgagtgatgaacatttatttccacctttctattagaaattattaaaatgataaataattattaagaattataattaacaaaaataacagaagtaattgcttccagcatccttgcaatgtcattttttaaaaaatgtatttttatttgtttttgagatggggtcacattatgttgcctaggctggtattgaaatcctggcttcaagtgatcctcccaccttggcctctcaaaacactgggatcacaggtgtgagccaccatgcctggccttataatgtcatttttaaatggctgcatcatagtccttgcaggacaggccatgccttctttagcgattctcctattactggatgtcttttccagtctggtaccactgtgactgtgctgtgatgagcatcttttttcctaaagcgctgcatgtagtgcaaagggctgctgacttaggtatctgttcttcctgcccctttcccacaggcttacctcttcccagccatggccatcttcaaggcagaagatgccagtggggaggcagcagccatgctgaacaacatgcgtgtttacggcacctgtgtgctcacctgcatggccactgtggtgtttgtgggtgtcaagtatgtcaacaagtttgcccttgtcttcctgggttgtgtcatcctctccatcctggccatctatgctggggtcatcaagtctgccttcgacccacccaacttcccgtgagtgctgctgctctgagcccaaggaatcgtcctcctacctccctggccctgtttcagagtctctgccaaactccccctccctgcccctcagaatctcagagtggtgtgggttgggagtagcttcccttgggagggaaaatctctcttagtttgggggcaatctcttcagagtgaggtaacttttctggaggagggaacaatttaccttgtaagagtcaacttcttgctggtagggtggacttaggaagaattaagtgggaatgagttccaaagcaatgaatgctgtctgtggtagggaaacctttcctgggtggggacaacctcctggaatgggacaatctcctagtgttggacaactcctccaggatgggaaaagacacagaagtctacagggtccagggactcagatccaagtccactccatccactgctcagaggtggagggcggcccccgagaccgctgtccacggtgctgaaacacagcattgcactaatgcggtgcttctccaccttggctgcttattagaatcacttggggagcttaagaaaaaaaaaaaaaagccaatggccaggcttcatttaaattaaacgaggaactctggatatggggacctggcgtccgtgtgtttaaaaggtctcccggtggctgtattgtgcagcgagggcaaggttatgtggctccccaccttcctcccttgtttctctccctaggatctgcctcctgggtaaccgcacgctgtctcgccatggctttgatgtctgtgccaagctggcttgggaaggaaatgagacggtgaccacacggctatggggccttttctgctcctctcgcttcctcaacgccacctgtgatgaatacttcacccgaaacaatgtcacagagatccagggcatccctggtgctgccagtggcctcatcaaaggtctgcggagggacaagggctggcatccagggaacgctgcagggattgtaggttaagcggtcaggattaaggggccctccttgggattcagctaaattcaatcagctttaattgagcacctactctgagttacattctgtccttggcatcagggaggagtaaggtgaaaaggagacaagtatctcaccgctagtaggaaaagaagtcatcaacgtaacaggtggtcactgagcacctacagagtgcccagcattgtgctgagtgctaggaacacaaaataaataagccacagttcctggcctcaaggagactaatggcagaaatagatgtaatagcaaatacattatgccatatgtagatgtgcattcaatgcacagagaatgcccggggggggagagttcatgtgtataagatggcaataggcttcctggactcaactgaggagggttttgaaggacaaatgaaagatcttcaattctatgagaggagtaaggaaattgcaaccagaagaacagcttgcctaaaagcaggcagaggcagaagagtttattgtgtctttccaatcacaagtaatttggtatgactggggcataaagagcaaaataaggtggagaaagaagcgatgtaggagaggctggcatgagccagatcatggcaggccttggaagccattttggagagttgggaccacattctgaaggcaatgaggagccaccaaggggttttgggaaagggagggacgtggtcagatctccattttttgaaggttcattctggctgctaatgtggatgggttaaaggggtgagaggagagaggcagggggcccaggaaggggctgaggctatgagtccaggagagagagatggtggttttctgagtgagagtgatggaatgatgtctgtgggaattactgcagtgcttctcaaccagggctgttttgccacccagtaaacatttggctgtgtctgcagacgtttttggttgtcaaaactggaggggtgtacctggcatctagtaggtagaggccacgatgctgctaaacatcctacaatgctataggacagtcctccacagcaaagaattatctggccgggagtgtcactagtgccacagtggagagaccttggaatggagagaaggggcatatttaagaaatattaaggaggggttaaaggacagaagttggaggtggtattgaagttggggaaggggagagggagcagtgtagggcagggtgtcagaattgatgatggtgccatttactgaaatatgggatgcaggaaaggagctggtttggggtgggtggagggtgagatcaatttgggacacatcgactcaatctgagatgggtctttatttgctcatttactccactagattggactgtttgatggtagtgactgggtctgattagtctgtgaaaggtctgtacatagcctggcccaaatcaggagcttaggaaatgtcagtggaaatgaaatagagataaggccggggagagtgagatggggttgatcttgaccctgactttttgccccctcccacctcctggtcccagagctctggtccccttatggctggcctccccctgagcattctgtctccccacagagaacctctggagctcctacctgaccaagggcgtgattgtggagaggagtgggatgacctcggtgggcctggccgatggcactcctatcgacatggaccacccttatgtcttcagtgatatgacctcctacttcaccctgctggttggcatctacttcccctcagtcacaggtgaaggggagctcagagagggaagactctgcctgtgagtggatggggaagagagagtcgatgatgatgttgggaatttcttagtccaaaaaccccatcatgaaagcaaccgtaacatttcacttcccattggagagatgagggaattaaggccaggagaagctaagtaacatgtccaaggtctcacacaagccagtatgttaggactagatcccagactcactgaccctgagggtggtgcccttttttctcatctgtctggtctcctgtggccctggcttgagtcctagctgcacttctgttttgcagggatcatggctggttctaaccgctctggggacctgagggatgcccagaagtcaatccccactggcaccatcctggccatcgccaccacctctgctgtctgtatcctgcacagctgtgctgggaccaccctcgggggagggcaagagggagggcagctgaacttgctgccttacctgctggtgcaggaagggtggggagggggaggactgaaccgtggggattctcctttatcctctgctgcagacatcagctccgttgttctgtttggggcctgcattgagggggtcgtcctgcgggacaagtaagataattggggttgatcctattctgggggaggggtgggtatagaaggctgagttctgggaaacagacccatcaggaggtgctgggacctgtgtgaggggcctgtgggagggaggccacggggattgcttgcaaagtcatcttcttatatttcatcttccttctgtcactccagtttgagaagcttggatggtgtctcatttcctttaggataatgatactttccttttctttaaaatggattaattcaatagtgtgtctaacatttactgaatgtccatgtgttggtcacacagacaggagtggtatttatctgtgttccctccgagattctggaggcagcacagataaataacacatggtttttgtactgaaggagctcttcttggtgggtctatactggccaacagactttaagtgcagtcggtaggggtggccatacaggaaagcccaggggcttcagtccagtccttagggatcttcccagggaagtcttctcagaggaggggaggctagaagtgtcttatacactttatctcacttatccttcctgcttttaaggctgagcagagattaggcagcttggaggaagggcattccaggcaatggggagccagggtggaggggagaaatgtgtgcgcatgcctgcagctgtgagtgctcactgtcctggagcactcatgtctgaagggcatgagcacacacaactggccgggtggtgtaggaggtcctctcagaatcactttccactggtaccaccaggcttctgtaagggaatgcagtgggggacgtggggctgggacctatgctggagacaggcctagaggcctggttttcagtatcaggaaattagagaattattttatcaaggaaaaaacaatggaacatttggggctctgcctcccctgtcacccttacagaacttagtcctgtggcaggcacacagttggttctgtagttggtatggagacctgccctggaaatccaggcagcactgctcacctggcatctcctgtccacatcattccaggtttggcgaagctgtgaatggcaacctcgtggtgggcactctggcctggccatctccatgggtaattgtcatcggatccttcttctccacctgtggggctgggctgcagagcctcacgggggccccacgcctgctgcaggccatctcgagggatggcattgtgcccttcctgcaggtcagtgtgggagaagaacagcccaccctcagtagaccagccaggcccctgcccagagagaccacacagtgacccagggccataaccagccttagactacctcctgggccacttctgctctgtactgcactggccaggcctatctggcagggtctgaggcacagggacagggtggtgtggggtgtcaggagttgggcagggcattgggtggtgccctgtctgtggcttctccttcacccagatggaaggataagtgtgtcttacttgggatttggcccatggtcagtgcatcccttggagcactgtctgctcttggggaaaaaataaatggccctgttttggcactgtggttggtcggagacctggggaggcagtcaaagggcaagaaaagggtagcttttaccatggtgctaaaaaaaaaagacggatggagcacagggtcgtggtggcttgctggcttcctgacagctcctctcccatctggtcctctgcagctgctttccccctctagggatcatttgaacttcatggcactggggtgccgatctcagggtgggcaagatgcagcgaaagcctgttatccatttgcattctcctggaggaagagaaatgcatcctctcccttcctcctctttggtgataggattcctgcctctactccactggttcccgaggctaggggagagggctgagaaatccttgaggtctcagtcccatgatgattgctctttccccaggtctttggccatggcaaggccaatggagagccgacctgggccctgctcctgactgcctgcatctgcgagattggcatcctcattgcatccctcgacgaggtggcccccatcctctctatgtgcgtgcctgacttcttgccctcccccctggttcagggtgtttctctatctgaatcctgcagccgttacctgtgacaacccacccagacactttagcaaccccaggaagttccccattggtcatagaagcccatcgtttgttatagagagattcatccacacgtgttattagggtgtgttgtgagggtatttggcttgaaaccccttcctaagcaccacagcatgatctggccacctcctgacttcctgtcccctttccccctttctctgcccatgctgttgtttctgtttctgcctccctttgcatctctgtctcccctggggccttcctgtgttccaggttcttcctgatgtgctacatgtttgtgaatctggcctgtgcagtgcagacgctgctgaggacacccaactggaggccacgctttcgatattaccactggtgggtgctctgtccccacacttccactgagccacttgctcacctccacgccaatcctcatcttactccagtccatcccctctgggtctaaggaccccaaacctgaagaggacatccttttttctccagcttttgttgaccaactcacatgaggaaggtccccgagagggtctcctaacaatcataaataataacatagcagcatcataagcggtctcagctggaatctctctcctgtccgtgatgcccaatagctcacaatgtagcagggaggctggaagtcagctggccagagttcaaatcatgactctgcacttcctagctgtgagatcttgggctgatgatgtagcttctcagaacctcagtttcctcagctgtgaaatgggcatgatagctgcacctgcctgtgggttcttgtgaggactacagtacatggcagatgctcattgcacagaggctgtagttctctcatcattttcctctatggctcttcatcctcacaataggccctcgggggcagacagagcagaaatgatcatgcttgtcctacaaaaggaaactgaggcccaaagagggcaagggaccggcccaaggtcccccagcaagactgtgacacaactgggctagaaccagggctgcccactcctgtctggatgctccggctttgctggtggccttctcctgggaggacccgtttccactcccctgagaccctggcctcagaatgcacctggccaggcctgtctggcagggtctgaggaacagggacagggtggtgtggggtgtcaggagttgggcagggcattgggtagtgccctgtctgtggcttctctttcacccagaagatcccatatccccgtagtcctcatggggatgatggtgtgagttcccctagaccgggctgtcacctcccaggtcttgcccatgccctgccccatctccctcttgctttctaagtcccagcttcagcaacagccctgctggggctcagaggctgggtctccccaccttgtctaggaccctctccttcctgggcatgagcctctgcctggccctcatgttcatctgctcctggtattatgcactggtagccatgctcattgctggactcatctacaagtacattgagtaccgtgggtgagtgtggggagtggaggttggggtggctggggaaggctgaagggtggtgggaaggagagggaaggggtcatgagggattggggtggtgggggtgagatgaagcagggagtgggagaggatggggctggagtagagggagagggtgatatgggatgacattggaagatggggggtgggagcagaggctttgagaaatggacaggaatggtgagagaatggatttagaagtgattttccaaggaaacttagccaaggcttggttgagtctgttggcaggagtgatacacatgtcctttctgagcctgagagatggctctgccctggggtagctggtgcagtgtagatggttctccctgccccctcctggctttctgctctcatgtgatccacttcccggctcccagggcagagaaggagtggggcgatgggatacgaggtctgtctctcagtgcggctcgctatgccctcttacgcctggaggaagggcccccacacaccaagaactggaggttagtggtgagggcacgggtgtgcataagagtgtgtgtgcatgagtgcaaggctcaggagacagggggaagggagcagggcctgacttatcctgcttgctttgttttgctgagtcgtgccctaaaagcccagccttgtctgattccttcccacctgaaacactgaggctgagctgagttccagacatttatgtgggtatgtaaatgtccacataccccaccatgctagcctcctgagcagtcatccattcattcatttcatcatttccatcattttttcataaaacatgaatgcctgatgtatggcaagtccccttctagtctctggggatgtaggaagctcacagttttgtggagaagacacacatggggacagacaaacatcagatcatgtagcatttgctctgagacaggtggaatcgttccctttgagagttataggggctcttaggcatctctagattaatgacaattcatccattttattcacgtgaaaatcagggatgccgagcgcggtggctcatgcctgtaacccaacagtttgggaggctgaggcaggtggatcacttgaggccaggggtttgagacaagcctggacaacatggcgagaccccatctgtgctaaaaatacaaaaattagccaggcatggtggcgtgcacctgtagtcccagctactcaggatactgaggcagaatagcttgaacccaggaggcagaggttatagtgagccgagattgtaccactgcactccagcctgggtgacagagtgagaccctgtctcaaaaaaaaaaagggggaaattggaggtcagagaggatctcacaggtcacagaaggcagacctggagatggaatcctcacaccccacctcttagccctgggtgctgcatgcccaacccctcactcatctccctgtgtttcaccttgccaagagtagagcctgaaaccctgacttaggttagggcattgttgacttgtcttggctgagcccagttgactaaactgggctcccagaacctggggctctatattatttatctgtgaattcccaaatgctcagcacatggtctagcccagagtaggtgcttagagaatgctacgaagttgataggtggttggaggactaagacggctaaatgactaaggaaagggatgcataaatagatgggtagatggataagtttatgtacacgtgggcgggcaaaagcatgaatcgatggatgtaggaatggatgataggtaggtagatgtgtggataattgaatgaataatgcatgtatcagtaaagaaatatgcatatgagtggatgactgaaggataaaataggtgggtgggtggttgaatgggtagataggtgagtgaggtgaatggagaaatgggttgatgggtagatgaatggatgggtggtgaggggtataggtggatgggacagatggttatagaggagagatggctagatgacctggtggtgggtgtatggtgtgtggatggttggttacatggtatatggattatgtgactctgcacactcttcaggccacagctgctggtgctggtgcgtgtggaccaagaccagaatgtggtgcacccccagctgctctcactgacctcccagctgaaggcggggaagggcctgaccatcgtgggctctgtccttgagggcacctttctggaaaatcatccacaggcccagcgggcagaagaggtgagcagaggccctggttgggcttgggaaaaggtcaggacacttaggaagacagtctctatccttttgtactttccttcctcatcaccttcaggatcaaaggaagtgcaggcatttcttttcttttccttagaggaagagcctaagagcctagacagtgagttctttagaattcaactcacagcatgaaagaccatcagaggcagaagggcccattttatggataaggaaactgaggcttagacaagtcaggtcatatgtctaaggacagaaaatgaagattcaaattaggactccttgaactcctactctagactccttcctgccaaagtataaatctttcaaggtgatttcccagctgtggactcttgatccctacagtctggggttgacaaggtgagtatccacatttgatacaggaagaaactgagacccagagagggaaagctgcttgctgaaagtcggaaagctgcttgctgaaagtcagaaagctggtgggaagcaacatcaggatttgaactcaggcccctgctctgtgtcacctgctcttggttccacccactagtccatgcttacagggcagcctacagaaccaatgtgggctgtggtggccagtgtctgccttaagcacacaaagaggtgattggatcccaagggtagtagaggaagtaggttctgtctgagggtcaggcctttctcccatcagggctgtggctagcagtggagagagaaaaagaggcccgaaggagcagaggtgagatggggaggggcaccccgatggcttgcgacagtcgctgcttctgcctcactgggctgttcacactgatctgtcagggcccagagctggaggccttgactggtcagttccattcaacacgcggtggctgagaatgtgcagtgcaccaggcactgggcgaggcacaggggagatggagatgttcaagaccaagtcccagccctcgaggtgctcacaggctggtggggaaggcagagcatacacagaaggctctcagacccaccggatgtcgataaatgctgttagagttaataacatcagggtcgtacaatgtgttgagtgttttcaattcctcaggcaggatactaactaagccctatgtgcatgatgacatgtggttctccctattcctaaacaaggtagcttgtcctgaccccttgggtggttaggtgactcacccaaggtcacacagccaggaggtggcagagataggagttgaacttctatctgtttgacttaggggtggtggttaagagtgtgggggttggagtcagacttccctgacttgaatcctcacagtaacattagctgtgtgtccttaaacaagtcttcctttctccaagcctcagtttccccatctataaaatgggagtaataagactatttccctcatagtacagtttaaatgggagcccttaaaatacttattatgctacttagaaagattgttgaaacaaattgtctggctgtgcagagaagcccagtttaattctggtctgggtgggggtggtatctgaagacggcgacatttgagctgggccagacagggtgtcatgtacaacttggcaggggcttgtgtcagggtgatggtggagagcatgtcgggcaggggggctgtatgagcagtgggagggtggcagaaagtgtggtcagatcatgaagagccttgattgatcaagaaggaatggggcacagagatgatggggagccatgtgccattctggagccagagactgacgtgatcagagctgagcttcaggaagattgggatgaaaggaggggagagatgggagggaaggaggctacaatgggcccagccagggccagggaggcctgaggctggtccttgtcttttccccctcccctagtctatcaggcgcctgatggaggcagagaaggtgaagggcttctgccaggtggtgatctcctccaacttgcgtgatggcgtgtcccatctgatccagtccgggggcctcggggggctgcagcacaacactgtgcttgttggctggccccgcaactggcgccagaaggaagatcatcagacgtggaggaacttcattggtaacgctattgggggctggggacagaagaggggtggggctgggggctgtagaggggtggaactggatttccgctcctttgggcctgaggggtttcccaagcactgcgtgccaagtgtggattcagcatatgcaggtgacagcagtcaaggctggccacgtgccagccactgtgctgggcgctggggactccgctgtgaacgagacagtcttggctcctgcagcgctcacaggccctgggaggaacacagtgcagggcagtgggaagagctacagctctgaagtcacagaggctaggcccacatctcagctctggtccttcctagctgtgtgactgtgcacacgtgactcactccctctgagatcagatttcttggtaatcgtaggtaatagtatatataataactaacgtttctagaatgagttctgtgtgccagcaagttaaggctttctctgattctctcatcagtcctaggagggctacgcattgttatctccatcttttttgatgtgaaactgaggcacagagagattaagaagtttgctccagctgggttcggtggctcacgcctgtaatcccagcactttgggaagccaaggcaggtggatcgcttgcgctcaggagtttgagctgggcaacctggcaaactacagagtaaatgaaaaagaagtttgctccaagtcacaaagtggggagccaggttttgaaccagcccggaggctacactgttagctccaagctattctgtctcctttataggtagatcatggttacaaggtgttgggaggattcagtgtggtcatacatgatgggctcttagtaatcagaaagggcaggtggtgttattgccatttgacaggtggggaaactgaggcctagagaggttgatagacgttcctagatctaaacaataaatatatgatggggcccaagtagatgctggttttctgaccactcagcccatggccaaggccagttggagtggggtggagtgctggctgccaggagcccttgtggctgctgctgggtgttgggagaaccagagtcactgtttccccctctggccctctccttggcctccctcagagctggtccgggaaaccacagctggccacttagccctgctggtcaccaagaacgtttccatgtttcctgggaaccctgagcgcttctctgagggcagcatcgacgtttggtggattgtgcacgatggaggcatgctcatgctgctgcccttcctgctgcggcaccacaaggtgagttgtgtgcgtgagtgtatgcacgtgtgagtgtgtgtatgcatgtatgcatttgtgtgcatatgtgcacaactgcaggtcagactcaggggctctggccagggtcagcttccgtgtccttcctcccctgtaaactcctgggaaagggatctgctgacctacttcattctgagatgttaggaactgatggtttctcctcttgcaggtgcactgctgtaaggagagcaatgcttagcccaagccagtgatgctttctttaatgggggaccctcagacctaagcagggaaggttttgtagagagtggccccaaagacagaggatttggggtctgcatgtatgtgtgaggagtgggtgggaagaggggaagggtgagcggacagggcctggccctggatctcctcatcacatctgggctggacctttctgaatccccttcatcgcctgcaggtctggcggaagtgcaagatgcgtatcttcactgtggcccagatggatgacaatagcatccagatgaagaaggatctgaccacatttctgtatcatttacgcatcactgcggaggtcgaggtggtggagatggtgagtccccaggagacaccgctggggttccacctggccctctttcctcttggccccagcaccaagtagggcaactctaacacccatcagcttatgatgctggatcctttccccctcatccatctcttagcctctcacatattcagccatccctcccttctctataaaagtagccatgtctagtgcttattatatgccaggcactgttctatgcactttatatgtacataaattccaacaacgaccaatgagatagatacaattatcagcatttccatgttacagattaggaatatgaagtgcagagaagtacagtcacgtattcattgcttaacaacagggatatgttctgagaaatgtgttgtgaggtgattttgttgtgtgaacatcatagagtgtatttatgcacacctagctggtacagcctactacacacaaaggcttattgctcttatgctacagacttatacagcatgttactctactgagtactgtaggcaatggcaacacagtgggaagtatttgtgtgtctaaacatatctaaacatagaaaaaatacagcaaaaatacagtaatcttaagggaacaccattttatgtgcagtctgccattgacgcacatacaatggtgttatttggcatatgactgtaatttgcccaataacacagagtacctggtggaggcaggattcaaacccaggcaggctggctctagagcgtgtgcccctggtgattatcctgtagagcatcttgtccaaccatcctctcaattcatgtgtccatccacccatccctctgtgttttcattaatctacccatgtattcattgaagtattcattcactcactctcccattcattcttgcatgtattcattcatcgctttgttctttttcttctttcccttctccattcacccaggtgattaattaatccactcattcattagttcatccattcatatgcctggtcctgtgctgggctgaggagggaatgagctgcctgccttgcaagagcattgccctctctgctacgtccttgcctcctacaacccttgacaaaattaatgattgggtagggaagccctaggctgccagaaggacgggggccttccttccttcccttggcctttcacctgggctcagacctcatgctttcctccgtgttcctctccccaccccccaaccccaacctctgtctgcccacagcatgagagcgacatctcagcttacacctatgagaagacgttggtgatggagcagcgttcccagatcctcaaacagatgcatttaaccaagaatgagcgggagcgggaggtgaggttgccctggctggcccctgagagcctcaaactgctgccagttctgggtggcaggtttaggatgcctcagggctgacactcctggcatttcaacttcaccctcatctccctgattcccccaaccacacctcctgaaactgatctcccagacagcaggagtatacactgcagcttcactgccaacctcccagccaggaggcagagggactttggtatgggtgacagatcttctcctctgtatgtgacttctggagcctgagagagaagagtggatgctaaatacgtatggatgatgagtccttaggggtgtgggctgccagtgtgagggataagggctcatgtagaaacccttagagagtgggtaacagatgggtgtttagagatataactgatgtgtgggagttaggggaaaatcccctagggtgtgattgatgggatctcaggggtaatggtgataagcccccccatagggtgtgggtgtaagatcttctaggtgtgggtgatgtagaaccaccagagtatggatgaaagacccacccaagggagtggagtccttgggaaaatgagtggtgttaccccagctggggacagaagggctcctggaggtgggtgataagttgcccagggaatgggtggcaatcctacacatgagggtaatagaaccatgggttttgagtctcccaggggtgggtaatgtatttatcagaatgtggttgatggattctcagggggatgagtgatgggtaccactttgagatgggaaggatggatcctccaaggctgggagtgttatccaagggaggtagtaaaaatggtaaaacatggcatggtcactgaccagtggactgaggactgacattggaccatagtgctaggcagagccttgctgtgccaaggttaacccttttgttgccagatgaggtctggggttctggagaggaggtggggcaggcagatcagtggtgcagtagctatttggtctcaaatcatagcaatattttaacaactggtacagttccagaaagtgcatcctggctgaacatcatctctggtgatagctctttgcagggcatgggtggtgactcccagcagagctggcaccaacctatgtcactccctagatccagagtatcacagatgagtcacgaggctcaatccggagaaagaatccagccaacacgcggctccgcctgaacgtcccagaagagacggctggtgacagtgaagagaagccagaggaggaggtgtgcagcttgggtggtttggccccaaccagtgggagcagagcccttggcctccaaaggactcaactgccatcgcttcattcatccctcaggtgcagctgatccacgatcagagtgctcccagctgccccagcagctccccgtccccaggggaggagcctgagggggaaggggagacagatccggagaaggtgcatctcacctggaccaaggacaagtcggtggcagagaagaataagggccccagtcctgtctcctctgagggcatcaaggacttcttcagcatgaagccgtacgggcctgggggctaagggctgggggctggggtgagctaaagggtcttgctccccatggcagagcaagagagcagaaggcatcctggtctgtcagcctgcagacccagctcagacattgtcttggtttctccatctgaggacttagggggttgggccccattgctaagtctcagaattcccagttgcaggcagcggaaaggtgaagggtgtgggggctggcagagcaggactcagggcagatgaccatggcccaagcccccagtgtcttcctctttttctgactctgctctttttctttctctctttgcatctcttgtgtttcctgaagggagtgggagaacttgtaagtgcttcagcattttttcattctctctcctaggatggccagggtccctaccctcctcactctgttgtgaacccctaattggtgccacgacctctgggatctctgaatagcctagcctggagatgtttaggattggtggtcctaggcttgcaagaaccagtccccagcagcccagttcgggctggaagggcgactggctccaatcttctctacccccccggctcacgcggtctccactcctccttcctgccgcaggaaccagtccaacgtgcggcgcatgcacacggccgtgcggctgaacgaggtcatcgtgaagaaatcccgggacgccaagcttgttttgctcaacatgcctgggcctccccgcaaccgcaatggtgatgaaaactgtatcctggaattaaaattgggggaaagagggaggtggacgtcagggaatctgggtcctgtccctgggatggaagagctgagctgttcctgcctccggatcagcacctcggacagggacacgggcgcgagaggtcccctggcagccgagcgcgaccccaatttcgtcgggagggaaggagaccgggtctttctccttgaccggctctcagacatggagtttctcgaggtcctcacagagcacctggaccgggtgatgctggtccgcggcggcggccgcgaggtcatcaccatctactcctgagaaccaggacctgccacccgggcccgagcgcgcccggcccgcggctccggagccctcgccgcgccccccgccgctgtcaccgtttacatacagaccctgtgcccgtgtcctggccccttaccccgctgcctgaagcccggaggccacgcctgttggggctgattcggagagggcgccccgccgcgcagagaccagagctcctcagtgccagtttggcccctgggtcttcgctgccctttttctaagcccggcctcgtctcgccggaggagacgctgcaataaaggttgggagaaggcgcggaaaggagaggagctggggccttggggacccccaggtagtccatgcggcccattcctccccttcccactcccgccgcggtcctcgctctgcgctcctccggcgctgctccctggctcccggcggcccggaggcccgcggggtgggaaggccgcgcttgccgtctccgccgccccttctcgccgagccgtggggcgcgggcggccgagcctatacatagtgtacaggagacatcgcgtgtatttttaacgtccccatatttatgtgactagaagcgcaacagacttctcgccatagtcgagctctcccgctgggggcactgcggggaggcgaggcctcgggaagctgaattttccttgacgtccaagagtttgagagcgaaagtgctttaggcccaggcgggggtcgtggcctcgttccctcgacacctccgtcctgctctcgcctcttcgccctttccgcgcgcccttggcttcccaccctcctctccagtccttttccgagatgaggtgagacaagggtccaacttttcctggattcgcctcccagcggacgtgagcttccactgcggctgcagagacgcgagcaacctcttctcatcggctcttatgcaagttggggccaggataggggaggggtgctcctcaagaggaagaaaccgagaggcccgcgccccaccgaggaagccccgccccggtgccttcgctggggagcaggcgtctctcctcagtcggcttgtcgcctgctccccgtatcccatggctcctcgccaaagactgaaattgtggagctggagggcgccccctccccggagtttcctccctgggacaagtgagggaggagggggccgattctggtttaggggccggacccactgagaggccccagagccgcccgtgatgttcctcccccgtccccatctggcagctcctgtctcgcctgagggacccagccgccttctccgtgctctggggccgggcctcgctgcttagcagcggcctctagctccgtctcccggggacctgggcctgagggagggctggagtcgcacgcgctttgtccttagcgcctgtctgctctcctctaactaggacccagggcctttggcttccccagctcatccttggcccttccgctccaccagcctggtctgaggcgtgctctgtccttagagaaggcgcggtggccgggttcccttcccctagggcacattactaagggggtcaggcactgcatgctcgttccagcaccatctgggactgggtacagtacctccagccccagggccctgacctgcgcacctagcttgacatctcacgcacctcccagagctggcgccactgagtaatccggacctcaccacctcttttcctttgagcccaaggcagagctggagctggcgccacccagacagcgtcaggtgtggctggggtaggtttggaggtctgccagttacaccaagtcccctctgagattcgatcaggggactggatagattctttcaggtactcaatcaggaagctggaggtgttagacaccagccccctgcatccttcagtagacctccctctgaacaccacagccaggtcctgccttctgggggcctgaatattccagagctgatgtgatgggctgtgcagaagggggctgtatcaacatcaattagggaaccaaagttgcactatctgggcccagattgtctggttggcaagagcaaagtttccgttgatgaaacagacatcccacaacaaaaacccaagttttctgtgctacatgtgcaatatttgttatgaatgttatcacaagtcattcatcaagttatctttataatcactgtagttagatgtttcatgtccattcaagtgacttttattctgagtgcaatatttcaatagccttgtagtgataactagtgttgcttttgttttagatgatctatgtgcagggcaatgcaatgaagttgaaaacccttgtaaataggagaggttgcaaaccaaatcaagagtatttattactattactgctattattattaggcctgcctttaattttcagtgtaagtgttcagtatgccgcatcctgcctcagtattgatcttgtgttctttgtgccaatatgaaaaggagagggttggttctttcctttattgttgaatgctcccatttaatgctttatggcttttactgtgttacttttttagactcccgtctgcacaaaatgcaataaaaataattttattatacccttcatggcctgagatgtgctgtttggacactccagggggccctccaggaggaccccacactcttaaatcagaaacactgaccaccgacagaagagatgggctaatggcccaggtctggtgatctaatttatccaccgatagctccagggccctggcctggagagcagcactatcatctcctaagagactggcaggcacttactaggtgtcaggctgcactggcatcttctaggaggtagtgagcactttctaagtgtaggtgtcaggctgcactgatacccccaggaggcagtgaacacttaactggtgaggctcagtgctcttggcacgttggtccctaactcactggaggcctgtgccacccacttcaccacacccaccccaagttattaaatgctcttcaaggctccttcaggttctatgaattctgccaactccctgcacaatgggtagaacagagggtggcaactgagacaaaatgaaaacaggaagtgcccccctaccaatggccattaaccacaaatggcctcctcacatcctgttttcctttcctagaataagaggacaaggctgctgacacaatgaatgtctaccagaagcaggatgttgaacacagcactataattagccaacaggcctttgctctgaactgttattaaagcctctaagtgagctacctatgaagagaaggcagggttcaaagaggtttgaggccggatcatatgctgaggacaaaagggggcagaccagagtcctcgagacaggagccctcacctctgacttggggaaagcatcctgcaaagagcatattcacacccaaaaaagatgaacaaagcttttacttttttcattttaattaaaaagtaatcatttcattttattaacaacacaagagttccaaagaggaaaaaaaaaaccactatataacacaaacaggtcagaacataaaatgctgccatttggggaccttgaattttgaaaccattgtttgcttaaccactggcagggactcagctgaagtcgctgctctccctcacccctgctagaggacctcaagactgtgatccacagggctctactgagcacaaaccctggggagagggcagcttcctggggctccatttagaaccacagccagaaaccctccttctaacaatttcactctggtacaaaagtcgcgaacagccacccatctcgagaacatgtccagctaccagaagtctgacatcaaagtggtccctacctcctgctgctcaggaaacagaataagagtctagacaaaaacaagagcctggggttttgagccaaaagcccaaaacaaatcactgaagaaacgggtgttcacggccagagtctcagaaccaacttcatggaagtgctgctggagagggggatgctgacagaactggttaacagggaagagtggtggggcccagattcacagtttgtggtaactgctgctgactggagctgttcagtccattggagatcttccaatgaaatgaaaacaaaaaagaaaagagaaaaaaacaaaaaacaaccttggctcagagagaaaaattcttttttctgtggctgccatggccattcctcaacaatccagagtggctgatttatgaatcctcaagcagaccccaaacatatggggtgagggtatgatgacactgtgcctgccaaggccagtttgcttttcttcaactctaggcaggagttgcaggcaggagcttgagctctggtcaatgtgtatgaagctggaaagccttggtaggttcacaatgaacaaaggtggtggctactgacatgacaaatgccattccaaacttggctagctgggcctggctccaaatccagtagaaacagggaccggagaaaccccatcaaatacaagcccagacacctgtactgcccccggagatatttattttctacaaaacaaaaaacaaaaaaagatacagccccaaatgcagtataaactttgtaaggaataagcaacacagccttgggcagaagagagagcaggtggtagaaattgatgacactcgatgccggcctgggagcgcagagaacatcctccaaacagctctatttagaacaagtaagtgggaggaggccaggggatgaggggactggggagagttgaaagatttagcttcagtaatgcctctggtaagatcccatgggggcctgtggctgccccatctgtgctgtggtctggctaaccaggtgggagagagcagggccactctggatcagggtatccagagccttctgtacacttggattgtcaaagttgatacctgtggaagacacaggcctctggctagtcatgttgctagcaggtgccaggcgactggaaggctggccaaaaagcccttgggaaggagccccaggtctggggcccatgttctgagcagatcctccctgtcccaaaatgcttggaggctgattgccagaagcctgtgatctttgttgaggctggctgtttgctgctgtggaaaaattctggtttggggtgtttccggcagcaaccgagggggatgcagagctgctattggccgtcactgtgccactattgaagaggctgaggattttggcctgaagctcttgctgggaggtggggggtgcagatggagtgggtgtagcagaggggagcacttggccgctctggagcggttgggagcttggctgtgtcttcagcgaggcacccgaggtcgccccgagtggttggcgggaaatcgggcctggaagacagaagagggaggtatctggttcaaagtaccccccaagggcaggaggcctagcagccaaaggaagaacaacaatcactgagtcacatcaatcatacagtacacagacgataacatcaatttcccaaagaggccgcttcatgatatgtgctgtttacagaaaacaataggctagttcccctagagaactgctaaaaaacaaaagggcatccatcctggctaccacggagccagcaatactagtcaatccaccacattaactatagggatcagcattcagtacccaaatataaagttattattaacattatatcagcatgggtggcccacgggagaacccaagggatggacttagttcccttacccactccaaagagccctgggcctgacaccctcccaacagagcctggggattagagaaatgcagagtcagaacttcacctcggccctgccacgtagctcaccaggcagagagtcggtgctgctcctcatcagccgctccttccgctctcgcaggtagttgatgatcttgtcagtctcttcagcagtgaggtacctgttgtctgccagcaggttgatgaggctctggatggctggagggtggcccccacgcactccctcctcagggcctcctctctctctttcctgcaggatggcttcatcggccatcttggctgcctgtctggcaatctcctcacgttccttctcccggcactcattcttgtaacgctcataatttctggccaccagcaccatggcatctgcttggggcatgttgcgatgctctgtaggaggaaatgacatgagttattttcttccatgacatatttaagtgcccacctgctgcactctgtcaagtctttcctaacctcataccagcaagaaaatcattttggtgacaaaaagccttgagattgagagtggggtggtgtggggggagagatgaaggccaggaagggaagtgaacgaacacttttggtgaggagatgcacctttatatacagctggttctttgggggaattcctagatcacagacttgtagtaaaaaccaaagaaacatgacatcctcccacagattcaaacagaccacgtggggaacagccatgggaggcaggcccaacagcctctagaccagcagcaggaggccaacaggcccctctggaaagcagggctctccactgtgctcctcaggacagagctggcctaccattttttaattcatcagttcaaaagtcatagattaagatcaaactgtgaccctaaataacctcctctcctcacccatgggcaacatggtttactgggtagtgagaggactccttagaacttttgtcctcacacatcttgaggactattcctcagacaaatgacccactggagatccttatgtaattgtatggttatgagggtaatgggtgaggcaaagagagatcctgcgtatagtgggaaaagggttaagtctgtgctgtaagagtgaggagcagggtatcagctggcggactcttaatcctctgggctcaatgcattaaaagctacttctgaggaggacttcgagaactgggcctgggcctctacagggtcacggcctcttagcccctctggttacttctccagcacacttacaaaaaggaccctaaatgcctgttatattctctgtcctccattagaaagctggcagaagcaaggattttgtcacattcagtggagtacatggcagaggtgtgctggagccagatctcagtggcaagagccaactgtgtacatttctttccaactctcccttcagtgacttcaggttggtggcttgaactgaaacatggtgggagtatttacaccatggagatcagcaaatgctataaacgccctccccccacactggaacttgttgttacacgtgtgccagcacaccactgtatatacctagtggctaagtatagtgtaacagagatccactaagaaactatcagataagtaagtgactatgcaagactcttccatggtacttaagagaggggccctaccatatatgaactgagatataagagtcatttgcccaaaacctgcttcttctgagtaaggcataaaggactaataatggactagtgactacctccggtattctgactctgtaccttgcggggttccaaacatgatgttgactgtgcaggagcggtgaatctggtgttgctgggtgatgacaatagcaaaaggagaacctcccctgctaacatcctccaaggcttgtgacagtgacacttctgtgttaaggaagatcaagtccactaccatgcccaggtctcgcaccttccgccccacagactcagcatagtctctgtaaaaataaataagatccaggtgagcgaccaactccaaatctgcatcgtgtgtctcaagccagttgtgtgtgttcctactgataactcaaaccttagtctaccccagtaccgtattcaggatccaagtatctagaccaatactctctctctaccctggctcagaacggttgtgacttgcttgagatcacgtcagaagttgccagtagcacagtatgatacccaggtccttctcttgattctctagccctgtggtccttccttaagaccatcctgctccctaagacttgtggcacttatctctttttgggtaggctgcacaacacagtgggaagatcatgggtttaacgctagaaacatgggtttggatcccagcccttaaaatttatttgcaaagttgtgaagcttaagcaagtccatttacctcttacaaacatcagtttctttactaataaaacaggagtaacatggctcagttcatacgtcatttttttgaccttccctccaatctaaattagatctctgacattctcttctcataggactcatcacctgtatgcttttgtcacctgccccattgggtgtaagctccaccagtggaatgaggctatacagccccaatacccgccatccaccatacgtataaaagatttgctgaatgctcattttttatgattactgtgaagattaaaaataatttatgtaaggcacctagtatggggtagtacataaagtaggtgctcagaaaataacagctattatcatgtgtccaaaaaaagctctctagagttaaaagcagcatctatcactgaacaagacagccaagagcctgtgaactctgcctactgcttggtgtctcaacacctatttccctagtcactgccttgaaattagctctttaaccccaaactgctagaaaatacatgaagttatttacttagtaccacctagggaaagggaacatagctactgccaagcctgcaagctgctatactcctttctgcttctctgctctgcctcttcaaggagaaaatgtaaaacagggatgcagtgaaacaatgctataagccctagcttggtaacatggtcatgtaacagttctgcaaggccatggtacttcacaaagacttggttcttggctgacaaatgcagaggcgtgtctcccaaagtattgggcatttgggttgtcccatgaagggagtatatactactctgcttgaccagcggctacaccctcttccactctcagtctgcatggttccacagggctaatcccacctctagctcttgggatgggaacatgacttagccctggccaatcagaacacccagcacccctgccaaagtgacaggctcagggatgggaaagtgagtcaggtcaatctaaaaagaactgcagaacttcaggtggaaacactgggaaagagaagttctctttccacttggcttgctaagctaagaagacacacgttcagggccagtgccattctgcctcttcaagcacaaaacctgcctgagaacaaaggcaaatctgaggaaaacagtgcttagagactaacacagagaccaattttgatgacatggtttgatcctggatgtggctgtgcctcaatttcccagttaatttttgcttaaatgaaaaatgtcccttttggcctcaatttgaattgagttttctgtcacctataactgaaagaaccctggctaacagcgcacagcaatgcaagaatacacagctcagattcagtggatagaggtgctaaacaggagcctgaatttctctgactcttctccttactggggagaaatatctaagggttcttactttgtctgtttgttgaccacaatcacagaacaatcaacgggcctttcggcatcaaagcgtctctggatttcctcaaaatattgacgataaagctcttctctacgccgttcctcacgtttcaaacgctctgcaaaacaccaccagggtaaactgaaataaggactggaccctcattttaaatcctgagctacttgtaggcaaaggtcataatactctgaatcaatcctctggtctatctcctaaaaacagccagtattaatattttttactattataaattaaccaaaatgtaatgctggattaaaggacgtggccattttaatgctgcatctgatacttactgccaagctgctccctgagaaggctgatactaatttatacctccacagaggtagatcatctagtgcctatttctccacaccttagtcaacagtgagtactgtcattctttttaagtcttgccaacttgacagataagaatattattattattctaatctgcatttttgctttttttttggggaaaaaatcaagtagtaaagtttaaaattaaaaatttaaaagttctttttttaaaagaaaaaaatcaagtataaagtttaaaattaaaaaattaaaattaaaaatgagattcttaaagatttcaacttggccaggtatgaaataatttaagaacctttaaagatgtattgagaaaaaccaggctttaaaaagacatgtttgccttcatctaaaaaagagatgctgttaggtaaaagttataaaaaaaaccaaaaacctattttgcctagataatgcagatagtcagtcatagttacttggtcagtaggcaaaaaacaagcacttaatgtcttcagctccaatcttttgttcatttttctcttttttttttttgagacagggtctcactctgtcacccaggctggagtgcagtggcacaatcatggcttgctgagacctcaacatcctaggctccagcgatcctcctgcctcagccccccgagtagctgggactacaggtgtgcaccactgcaccaagacaatttttgtatttttttttgtagagatggggttttatcatgttgcttaagctggtcttgaactcctgggctcaagtgatctgccggccttggccttccaaagtgctaggattacaggtggtggccacagtgaccagcattttgttcatttcttattgctggaatttcatatttatttcttcttgttggatgactaaaccagatgatggtactaatttgcatcttaaaaatcattttcaagccaaatgctctttacccactaataagctacttatatttcttctttttatacactgcttggccaaggcactagccctttttcagatgggggtactggttattagtttcctctctcttttgtaaagtgttctatcaataataggaatagactgtttcagctactttaccttttgcacgagactgactttctgggcctggagggccccgtccatcaaagctatctctgtaacggtcaaaataagagtcatcctttctcctgcaatagtcatccattcgtaggtatcggtcataagagccttctctcctgaaaagttaaggaaattttcataaagataaaactgtgtcttatcctgaaaaagtcacctagagaattctctgggattagacaaatgaggtttatatctgggactcactgcattatcagctctgtggctgtgatagagttaacctgtctcactgagatgatgtacagaaagcacttagcatggtctttggcatatattaaatgcaaaataactggcaggaattattgatactagttttgaggaaacattacatgtccctcccttgtgctttttaaaattatatctaaacgcatataacaataatttgccattttaacaatttttattattattattattttttttttagtagagatggagttttgccatgttgcctaggttggtcttgaactcttgagctcaggcaatccaatccgcccacctcggcctcccaaagtgctgggattacaggcgtgagccactgcgcctggcctaacaatttttaagtatacaattcagtggcattatattcacaatgctgtgcaaccatcaccattatctaaaatttttcatcacctcaaacataaattctgtattcgtgaaataactcccctctccccagccactggtaatctttaatctattttctgtctctataaatttgcgtattcttgatatttcacataaagtgaaatcatacaatatttgtcttatgtctggcttatttcacttagcataatgttttcaacgtccttcatgctgtaccacagatcagaatttcatttcattttatggctgaatgataccacattatatgaatacaccacttaaaaacaaatccacacagtggcttacacctgtaatctcagcactttgggaagccaaggcgggaggataccttgagctcaggagttcaagaccagcctgggcaacacagtgagactccacgtctatacaaaaaaattagccaggtgtggcggcatatgcctgtagtcccagttacttgagaggctgaggtgggagaagtacttaagcctgggaggtcaaggctgcagtgagctgtgatcatgccactgcactccagcctgggaaacagaatgacaccttgtctcaaagaaaaaaaaaaaaaatccattaatctgctgatagacatctggagtgtttttaccttttggttattgtgaatagtactgctatgcatattcatgtacaactgagtccctcttttcaattgttttgagtgtatactcaggagcggaactgatagatcatatggtaattctatgtttaactttttaaggaactgccaaactgttttccatagtggctataccaatttgcattcctacctacaatttctcagagtttcaatttctccatacctttccaacactgttattttctgttaaaaatgttgaaaatcattcatacattcagcaaaatttattgagcagcagcacatctatcacttgacagtcaccagaaataaaaggctgataaaatgactgctcttacagagctttcaattagtttagcagaacatacataaaaagaactcaggaaaaaacaagcagagtaactacgtatgtacctgtacataggatctcgggagtctctcatgtctctgtatctgtcgtacatggggtctcgctgatctcgaaaatccctagagtctcttagatcacgaaagtctctaagatccctcacgtcccgaacgtcgcgcacactcctgctgtctctgtgatcccgcaaatctctactatgtctgtggtcccgcaagtctcgggggtctcgaatgtctctgctgtcccgggcatcccggccatttctgccatccctgggctctctccttggacttcctcgaattggggatcgatcacgccttgaatctcgactgtctccaaagccatatggatccctgtgggaggtagcaagaaaatgctaagacaaagaaattgaaagtagccaacccatcagctcttcatatgagaaaacccccaccctccaagcattcttctctaaaacagggcagccaaacagaacatgactcaacatttaaggccagtcatccatctggtcagcaaatagtctagaggttccacaatctcaaaagattaggacatcaaaagaatgcatgaccaaaaactgaaggttttgactggataacagtattcatcaggctttcaaagtgaaagtgtctttccaccagacttgcttgaaagagactttacaaggggtaaaaagttggagtgacagagtaaggaggcaagactcatgaagaaaaaaagagcgaatggcacaatcttataaaagtgatcaaaggaactgtccttaaagtacggaaaatgcacttgaagtatcttggcaggataataaaattaaggggaaaaaattactataagatacatacagtaaaggaccaagaacaatctgtttctctgttttgtcagggctattgagtattggtatctctcaatctgagggtttacgtagaagctgattccattttgctcaagatggtttaaaaaaaaaaaaaagagaacaaaacaaaacaaaaaaacaacctgaacagtgaagtcacagatatgctttgtctgctctgactcaatgttcttcatgagacgtttcaacccactggaaactcctcttcaacatatttaaaattaaaaacttcttaccccaaccccatcagtcccattccccacttttccacttttgacaaaatcatctttccacttatcaagttttaagttcttgaatattaactatgctttttcttcccccatcccaataaagtcacttgtgtcccgttcactttttctttccattcccattggatttgtaagtccaatccaagcccttatttctattctgacaccaacaggtttccaaaacacaaaattaaaaatcaacctacttgctttcaattcattcaacacataaatacactaactatcctaaaatgccaacttctatgttagaaagcctaataaatctgacagctattatctccctctcatttctaattcaacctcctcagttctacttaattcttataactcacaagatataatctatctcaatagttttatttatttgatttctatacttggaatatttttcctgcactaatccaagtaccatccaatccacacaggcaagttcgtgtcccatgtcttccaagaaaccttccctacccttcctaactgctgatctcttctgctcagctcagggcactttctatctgtattactcatcttgatctggcatttacccttttacaacaatgtcttatgtctgacccgctttaaggattaccttctccgtaaaacctgccctgaactcttgatcttccccaacaaccatgctcctcctccagtccttcccatctcagtaaatggcacatccaactactcagttactcaagccacgaaactggatgtcatctttcccttaaagcctcatcctcccttccaaccacatttccaaattttctccattctttctcagttctgcccactttcctttaccttctttggcaaaactgaaggccagcgcataatcatctcaccctcaaaccacagcaagagccttctaaagcagtctcctcatttctgtttttgcctctttccaaatctttctccagaaagatcactctacagtgatctgttacgtatgtaaagcccttccctggtttcccacagtatgtatttatttttatagggatgagatctcacctatgctgcccaggctggagtgcagtggctattcacaggtgggatcacggaacactacagccttgaactcctgggctcaagtgatcctcctgcctcagcctaccaagtagctggaactacagatgtgtgccactgtgccaggctcccacagtatttagaattcaatctacaacctctaccaatgccatgaaggtcctgtataatcttggctcctgtcttctctaaccctgtcacaccctctccctagttcaccactctttgccacaccggcctttcagctctgcctagccaacgtctttcctgatccctttacgtgagtagcaggaagagatctatactcctcttccaggtctcagcatataaatatcccctactccctgattgttagattcaatcaaagtttactttctgcccctaaaattctctcatagcactgttttcacttttgtcatttatcacaaattgacattacatatttacttaatgtctgtctgccctactagactacaagtgccacaaggacaagaactatgtcactttgattctgcactacaaacccactatgtagaacaatgtctgttatacgacagatgctctatatgtatgttgaatgaatcttgctccagtacaaacttctataaccgcacttaccacactgttctgtaattgtttacgtggcttccctaccaaataagaagttctcttgaaggctttgtagctctaggatacaccataggagttcagtaaatgtttaatgaattgaattattctactaaactgtaagcctctcaagagcaggcagcatgttttgctcatacttttgtcgtctaccatggttacacacgttaggtattcatcatgatgtcatcagcttgtggaaaacctcacctcagctacacgggcacagcaaaaacaatttaaatgccaattttgcttccatgaaaaatatttgttatatattctaaggttcaccagcattcctgacttgtgagagcaaacatatcatagaccagggactttaaatgagaatagctaagcattatttttcttattagaataaagtaaagactaaccaagattcttacttcaaccttccttattacatcatataatcttcctaacatgtaacatctgatgtagcatgtaatgtgggcaaacactcaagatccaaagagaaaggacaactgcaaagtatttttggattaatgatcggcagataaacctgccttggggagcagttagaagtagtcattagaggtggaatccaatttcaagtgttcttggcaatcagggctgagatatcatgatcctgacagaccacagaccacacacaaagccttgggctggtggaaatcggggtggggcatgtcatagcatgttatttaccaccttcggagtattataagtgttatgttatgattggtcctcattcttttgaatccactgaaaaaccttacttacctgtcaaagtccatccctgcaagttgactaaaactctagattcgcaaagtctgggttcaatcttccagtctgagagggcaagccccaccctttccctcaaataatttgaagtccatgtgcaacaaaactactaattccctctcaagtgccttcagggtaaaaatgtagaagaggtgatattcacaaaaggaaaaagaaccaaaggcatggtggaagtagggacaaagaagataataattttctcaaaaggaaaggcaaagccttttttcctttctccaaaagataaacactatggtagactgctgttcttctggagacgaaaacaaaacaaaaaaccctttagggttgctttaggacccaaacaaagaactcctcagaacaaaagggctcctgctgctggccccaacatatttttcaaaacaagactacagctaacaaaagggcagtagtatgcacgaatcaaagtgcaagaagacaaagcttcctgtgggagacgctggacctcagatgataagtgggttagaatcaggtttctggagcataataaggttaacaatatcatcccacagcaccagaggtgttttactaaaggaaccaaatgcagcataccctcaggtactacatcactagaggataaaaagaaactgaacagtggttaaatttcagcactggagtccacaaactgaaggcaggtggcaaacacaactaaaattctgctgtaaattcctcatctattcaggagggggaaaaaggcaaatactctttgccttgaggggaatatagtcacactgctgggaaacatttgagacgtaagggcgaaaggggtgaaggggaaaacaatggctctggtggcaagtgatgagcttctggtagaatgtgtctcttcctgaggactaaaggggtgtgcagagcaccaggcatgtgacagcctacagagtaagaactgatagatgatcatcttggaaaactgtgatggactttgaatttctctttggcaagagactgaaacttcacatccaagatggttttctttggctttggttctacagacggtcagggaggaagacccctgtctttttctttcttttctgcaaaggtcagcatctcctttcttcctttctgttcaccggaatgtcttccttgggagggccagcctctttctgaccctgaaaaatccttcattagctcttcaaacttctgtcacagatatactgtccacaaatatcatcatctaaatggctggctgctgtatgatgttgatcctccaccaggagggcttcatgctactgttagaaatggagacaacagacttgtccagaatattgccattaggtggaggtaggatatggacgtgcaatgagatatcacacctcacagacccaaattttacacatgtccatgcttttccttaggaagcactgacaaccttctccagcacaaacagaactttcttattggtagaggtggcagctgctgagaactgatgacttcttcaagtgttactgcagaggtaatcacaacctggaatttctttgtggcccacctagagcaagggctgtctcacaaccagggagcaagcaataatcaaaagcattagggccctgtggataagcagaaagcatttcaggtcatataagaaacttgtctacagccaggttatttctgatgagccgatacccaatgactttcaccaaagagataccaggtttaacatctttcacaaatatatggggaaaaatcctctgcagagcgttggatgcagacaagttaattctatttgttcttctttaagtcattcagaagtacagtcttacttcttgtacctagaggccacatctgcataaagatatgctacaagatctggactgtcaaggtgttgagctgaagatggtaactgagatatctaaggcacaactggaatcatgatcctgtctttgaagaaggactaatgcttagtatcgatgcttgacaacttgcatggtaactatgcaaggtactcacaggagttcaatgaagtggccctcaagagttagatgataagaattcaggctgaaatgtgatccagagcagagattcctcatgcagagttctgtgcttggctgggccaatattgtcagaattacacactgacagctggagtcatcagggagtcatattattgaatagagagcaaagccagcagaactgtggtttactgaaacatctgaagaggtgataatcctgtaaaactcccaaagatacctacgttaagtccagcaaaacaaggtgttataaaggtcttgccagtatgcttataccaatattcttattaaacgtagaaagcgctaaaaatgtagaggtataactttaggaaatatttgccataggtagtgttttttttcccctgtgaatgatgcaccccctgtggctgggggcatacaaaatgattagggctgccaaataaaggcagtttgttgttgtcaactattgatacatttggagttatctcaaggctttgactggaagcatgcacccaaaggaggtacccagtgttcaccctcagttaaatgatttgccccttccagattaattacttgcccgtctcacctactctttgcaatttatgtctgccctattggtatatcttaagagataaagtatgatcaggacaatgattaaaatgttagtgctcgctattttgaatacaatgttaaacctgtctttttttttaaggtaaaaaactgggattttgaatacaatgttaaatttgtctttttttttttttaaggtaaaaaactgggactcttagttcggtttttagatggggttactaatggtgaccatcattcttccctgaagcaaataaacatgactgtatggaacttcatcatgttaaataacatgctgaggaacccagctagggaaatatcaccaaggggaagatggattgttaatggaatttgaattagcctagctgtccctcctgttgattgtaaataaagcaggaagtcactgccctatccacaccaccaaatgacctcattttacaattgatttctgaggaaggtgatattttaaaaggcatacaaaggtgacctgtatatttatatagttggtaaggagctcattttattttttgagacagggactcactctgttgcccaggctgaagtgcagtggtgtgatcacggctcactgcagcctcaaccccctgcactcaagtgattctcccgcttcaatgcctccccagtagctgggagtacaggcaagagccatgacgcccggctatttttttgtagagatggggttttgccatgttgcccaggccggtctcaaactcctgagctcaagtgatccgcccacctcgtcctcccaaagtgctgggatcacaggtgtgggccactgtgcctggctagaagctcattttataaggccctctccagtgctgtctgtatgtttgtttgtgcggggactattatttaaaaaaagcataaaactatttctagattggggtaaattaatatttttaatttaatgctctggcaacggctattactgggtttcaaccagggaagttggtcattccccaacactgcaatgtttgttgaatatctacaatcaactagaaatgttaaaagcatttggttaagtatcattaacaggatgatataaaatacccttctcaatccataacagaaacaggatctattctctattctgcaatgtggcttatttgttgttgttgtttttgcctgcagaaacacacagacattatccagagatcaccaagtatcatggagacaacagagaggggtaggattttactagcggagtcagtgtcttttatagttacaaattccacactcctggtaagtcaccaggaaacacacacgttagcgctctttggaaattggatacacaccttatctcctttcaagccacctggcaactaaagattccaatgggaaccctgtacttctgaagattagatgcaactcttatccacctgtattccattctgtgctgggacaataaggagcaacacagataggactgcccaagatctgtggcatggttagatgaaggctaatgaaagcagacattatacggaactgctgaagttctgcaggatttgtttatgttcttcaggatactcacacatacacacaaatcaaccaacagagtatttacctgcaagctgcaagcattctttagagagaacagacagaataccaatttacatgcccacttccgcagtgaaaccaacgaatggccagggaatccacacgacagctgtggtatatagctgtagctatggtattggattcaactctgctgcacaggcagagtggacaaagactccaactgaatgaaaccagcagcattacttgcccttagggtctgcttaaactgcagagtgggcatgcgtaatctattcccggtagctagaacttcacatccaagtaggagtatatacatgaaacacacagtggacattctttcatataagcaggtaacaaaatacaggtgtttttgtccaaaagcaggacagctgtatgttatgcgtaatgctcagttagttgggttcacaaggtgaccagtggagctaccagtacagacgaggattcactgtatgcagcactgtccagttcactgtaggaaatgcagtttactgtggtacgtagtttagttatgtttctggggaaaactggcttttttacttagaggcaaggcaaaatcaattaatccatttgggccttgaagagacaccagatatgaaatatatcattcgtatgaaatatatcatatctgtctgccctctacacaaaactgcatccacttgtgtgctgttatggggccagaacaattgaatacagtatctttatttttggtgtaaatggtatcattaataaagctcttctttgagaggagggaccaatttaatgtgtatcttgagggtacacaccaggattatctcttttgtatacaccggaaggaagaatacattgggaaaacaccctcgatttccgtgaaagctaagaaaaagggagaccttcgagagctggagtgttttgccctttttatttcccctcaaacagataacccaagtatgtaagcaaacaggggatctgcagcacaggcacagcggcaatctctcaagcagcactttccgtaaacctgggttaacatctggaccggcagccatttggaatgaagagtcgaatctctgctgcccactgcagtgcagcatggcatacaccaatgactctggggcactccttctgctctggaggctcccaatgacacgtgagctggggacagacagaggtttatcctcttccaattgcctgcaactcatgttgcaagctgaacttgctggatttgccaccgaaaacacaaagcttcctctgtatctcctgatgtatgtttaaaaaaagcagcaaggcccttcacacagggttcatgttcttattgtttgcttgagcgtttcacttgttggggggaagaaaagacctttggtgtacgaagctgggcttaactccccagagcccaactctcccaaggtaactcacggcttcagggtactttaccttcgtgtggggctgggtcttgatggagccgtattcatatttcttctttccgctgccttattaatatctgaaaagaataatcaacccatctgttcaatgctacggaataaaaacaagatcatcagcacatttcaaatgaaagcaacaacaacaaaaactacaatgacaaccagatggtgtaagaaaagccattcagcagagacacactgtcacttgggcaatttttattattgagttaaggtagtacattgtcacggcttggtaagaaatgtcccttcgttttctagttaacacgtaatttgtcttaaactaattacgtcaatgctttaacacgctgccaagacctagacctgacacattccctccaaggggaggaaaaggttgttttctaaactcttagaaagcagctgtaagattctttttgtgaggaagaaagtgggggggaagataaggagagtttaaaaaacaaaagagcaaaggcaaataattctattttatgttactaagaagtaatagctggatttcattgtcttaaaacttccaatatcccatgaagcagggcctcctgttagtgtgtcttgtgttgaattccactggatagaatcttccagaataacatgcaggaaagaaaattattattattatttttaataaacaaagaatatgacctgttaacatctacagataaccaagaataaggactggcgtttggtatagtagggttaggtaataaaacactcctcctaagttgttttcattagagaaggctggcgtatagaactagatatgggagaaaagtagaatcacataagcttaaagaaaagcaaatttgtatagctaaagcctgctttgctaaaaaccaagaatacctgctttacaaaaattgaagtgaataataaataccatgtactaagaaatctatgccccaaaataatacctgacagttttcatatgacttaaagctaaataaatacattacaaatttcatacttcagatgaatgaagaaataaaagtgctttctgctgcagtagagtttgttcccctttttccgtattaaacaattaatagtgtatctaatgacatcaaatggtattaagtactcacataattcgagtgctttaaaataataattatgtattttaaaaatcccaaccagattcctatcacatgaaagaccacagcaataacaagaaacttagaggtctggtagagattttatgctgctattttgccaacttttgagttcctgatcaaatgaaggtaatcttcaattccattttaaatcagaagtctctaatttgtctagaaaaatggcttctgacaaaactgaaaataatataaagctaaatagtgaagtatatcttaaattgattcttaccttttcaattaagcagacacaagatataatccttctattttaaaaaaaacctgaaaatattttctatgtaagacttggccagtaatatctgaccatagctttgctactgcatgcagtactttcacaatttacaactcttaaagtttataatggtctaaattacaaattatataatgacaggccttatagggaatatctagttctattatacgtaattgtgaagaatactagttcaggtttatgacttactgagtctgttcacttactgtgtaccactttctaattatataggttggctatgattcagagagaaatataatatctttgagtattttaagtagttttcaaggtgtctctggaatacactgggtgtgtattaagataaaaaatatacataacataacttcagcaggagttcatatattattaaatggtcttgtgaataaaggaaactcacatctaaacactgactagacctggcaaacattcaggttaagagtacaacacatatagtattactttaattggtaggtttctattaccaataatttgctctctacatatgaaaaggaatattacactgtataattatagccagtttcgtgagcatctacatacagaactggagaaatcacatggtcatgtatactatatctttggaacaaaaccagttctagttagaatgaaggacataaatattttactttgaagctggtggaatcgttttgtaattacttaaaagattaaagaatattcaagattatatctttaaaccattttgattgtaatttgcctcgtagtatctattttcattgggtagtccaaagtatttatatttgacagcatgggatgtttcttctgcaaaaacaagaattctcagataattgtctcattttagggtttagtaaacttttagtgtagtatgtcaagtatctgtttattcatctctatttaagagttccttaaatttccatctgggctgacgtatggagaaaatgagacctggatttttttttttttcctatctaatagaattgctcagattagggtagggctggggagttttcagtgagagttgtaaaaacacaaccaccaacattactgccaatccccatacacccaaaaaatcctaacacatgtgcacatagaacttttgggaaatccatgagttcagaaatacagaagaataaataactttaaggaactaatcacggagagcaaagattcaagaagtcaagaaaaaacttccctcatcctattttttttgtcacagaatttgaaaacctgtcagttggaagcagagggttcatttaaaaaagattttctttgaaaatgcaaatattgagaatgctaaagcaccaactcacggctttacataaaaggaagaaaccagaaaataatccagaaaacatgtaggaaatgacagaactgttttaaaccacaaaagaatggggtgaagaattcccaaagaaagacacagtatctaatctatagttttattttgtattaaataatcagattattttctcctaaatccttatagagagatataatcaacaccaagcaaatagaaatggtgttaatgtaaagaagggaaaaaaaggtagaaagacaatttggagatctttctggacatcagatggggaactctggttggagaaaaattaatcaacaagagggaagtggcaacttgggaatctcttccaaggagaggtctaatgtctcctctgaatagaaaagggaagaaacggtacttctttccccttctgctatactttattctggccaactgcccttaagaccaaaagtcatctctcagtgtcttctccacttcagtttgggtgatacttctatactttgttaattatactagcaatgtgaatgccattcaaaatcatcataatcaccatgaagtgctttatcttggcctgaatatctatagtgtccaagtggtggtctgaaaacagttaaaagcacttctcagttaagaatttttagacaagaaaaagagctttacatacaaggaaaagaactggaaaataatctagaaaacatgctggaaatggcagaaccattataaactacaaaaggatggggtgaagaactcccaaaatatacaatatctaatccacaattttattttagactaatatgccagacaggggtcacaaaatggtccttggataatgctataaataaaaatgcatgtttctttcactcacagtaccaaaaactactttgttctacttattttttaattgtacaatcataaaacaactcttttcaccttaaaaccagattttatagttcataagctacagccacagaaaacaatgaggactaggaataacaagagcggtgtcaaagaaaatttccaggaggccattgctttggactgagctcctgaactaggcccaaagaccaaaccaaattcatgatgaagttccacgctatcaagccaagacaaagatcttttcctgacgttctgcgaaatcaggagataaataatggccaaaaccacaaataggccagttttagccagcatgaaaaggaagtctgcactgctttacccttcacaagaaaagtaactctgaaatgaccaatccgctttttgctccttgtctctgctttcctcagctcccttctctgtttataaagccaaacgcctctgctcagctcattggaacacttgttctattttatagaatgaggtgttgccctattctagagttgcaaataaaagacaattaagatctctaaactaagtgtgctgtaattttgtcttttgacagccacatgaactacaacacttagtgacagtaccaccactagctgttcaaagaacccagaagcctatactgttttaataactgactacaaatgacataaaactctctaaaaggcttagttgaaaaccaactaacaatcaagaattactaaagtggcattacatgctgataaagataatgccagttggaaaaccatactgacaagacagagaatatcacacattaaatcccccaaattgggaggggaaatgacaggacttctcgctaaactatatttatgaagacaactttgatgatatattgcaacatcagggatattgtaatgagttatattgtaacaagtcagggataagagaatgttatgcttgctctttctaaatcaaccctttaagttcactttgaatactatactttccctatatatttgattatctcctttattctccaactaaaataattattacatctttaactgtattagaatattattcctgggaacagaaatgggggaaacaatagtttatacttacagaatgcttattttgttcctgagcctgtgtactaagaacattatgtgtattatttcattcaatccttttacaactcttggaattaaatactgctataatttctactttgcaaatgagaaaatttgaagtttagagaaattaagtgacaggccacacaattatcaggaggcagagctgagactcagacccaggtctttcttacaccaaagtacttaaacattatgctatgctgcctccaacggagtggaaagacatgctttccatttagaatattcttgctaggactccctgatcaaatactgatggaacctggaaaaggtccagtctatgctagacactccattgcttaaatgacccagagacacccaacagggtagaacctacttattcaatgacgacttcagtttctattacctcaaactacagtgtttctggggtttgctattaacattcaccacaactcttccgacaaaaattatcaacatttaatttcctacctttcttattcttttaaggaaagggcatttggctggggatagcaaatctgagctgtggtccttactttgggaaatttactccagtcatttgatttctctgaatctatatttcctttctgacaaaatggatattctgcctgtgttagctatgttgactcaaggagaaaaatcagctgagaaaaaatgattttggatttgcaaaggttgagctaatctaaactacaaaaaaagagtctgagctgcttaaaattttaaaatacagatttaaaactggcaaattttcaactaaactgtacaagtggagaacaagtgatgaatttgaaaaggatagcttataattaatacattgaatgcttcattgattcataatgtcaaatgcctactatgtgtcacacatgtcccaggccttacacatgtggaaatgacacagctaaagtccttgccttaaagaagttcatttttaaaaaagaaagggtctcagctctgttgtccaggctggagtgcagtggctcgatcataactcactgcagtctcaaactcctgaactcaagcggtcttcctgcctcagcctcctgagtagctgggacaagacgcatgcaccaccacacgcagctaatttttttttttttgagatactgtctccctatgttgcccaggctggtcttgaacttctgggctcaagtgatcctcccacctcagccccgcaaagtgttgggattataggcatgagtcaccatgcctggcctggagttcactgtttatttaataaaggagaggcacaagtacacagataattacaatacaatctaaagtgggattatggcagagataatggagtcctaattttgtgtatgtgtgtggcaggtgaaaggaacagagcagagaggagactaggaagaatgtgtgtatggagggggtgggggtgaatgggatgggaggaggcagggaaggcttaaaaataacatttaaactgggtcctgaggaatgagtgggagtttaccagaaagagaaaagtcatcccagaacatacaaaggtaaaggaatggtgtgaaggacataataaattagaaaaactacaggaagtttggtgttgggaacacggggataggaggaataaaagagagaggaataacatgaagcaagagttggactagatccagattgcaaaacactttgctatggacaaggaagaatctagtggctagagggtctattgggggctataaactgaactaccacagagtctcaatgaagccaaattaacgaaactttatgtatattatccccaaatgcggtgagggagtatttaaatgtaagacattcaaaatattgcccattttagtaacattcttcaaagaccattggtttgacactgaaggagaaaaaaattgaaaaagtcatgattttactttcaataaagggctcccatgtagctaggaatacaggtgcatgcaccaccaccctggctaattttttttgtagagacaggatctcaccatgttgcccaggttggtctcaaacttctatcaaaagggatcttcccacttcagcctccccaaacgctgggattacaggtgtgagccactgtacccagccttaagatactttacagagctaaaggtataagacaagacactctgttttctaatgcaacttaagctgccctgatccttgcctaaagttgtctggtctttacataggatgtctggaaaagttctgattcttatgaggtgaactatttccttaacataaaattggtccagatgacctattatctctttttttaagtgaaaggataaagaatgaagatgaccattcccataaatattcatatctggtggtaacaaaaccaccatttaaaaagcagcatgcatgctggtattatatatttagctgtcaatatacttcatatttctctaatgtactgctgcttgagacagtggctttaccctgatcctgtcattaatgactctcattaatgagagtaacataaaggataattctgttagtcattgctcttttaactttttgacagtttaactctgcttaagcagaatggtctaaacaaatatatgtgctattcacaggacaactatttttgcacaaaaaagctgatattgagctttaaaagcagctgtcttaaagatatgcagtaatcattaataaaccacaaggtacagagaggaaatacagcgtagtagaaagagtagtcagttctgaggaacactattacttcaaaatattcatgagaggatagcaggagaaaggcatcatgataacttcctctctcagatattgacattgcacatatttagcacataaatgcctctgagaagttttggagtaaggacaccactatatctcaacatttcccaattttgcttgaccctgaaatcaattatctccaatgatgtcttgaatatgttctactaattatgtgatctggggcaagaaatctaacctctttgagtcatcatttccctataaataaaaaagatcaaactagtttatcagtctcataagatgacgggcaggagcaatgatttagtatttaccatatgcactactggctgtatgttattatcattactacactaagagtaacagtgacttcaggaatagacgtttcattcttcacgtggggagtcaaaaacaagagaacaacctaaactgaagggaagaaaaagtttaatatatttcttgtgaagattttccattcttaaaagcacaactaaattttattaatcctcacagtagtaaaacattacacaaaggcactgccatctgcaggtcataaacatggactgcttgcaatgattatttaaaatgaagtttcaaaccaataaatcttttctcatcagactacgaaagtctttccaaaaattgtttattctggttggacgcggtggctcatgcctgtaatcccagcactttcggaggcagaggcgggcagatcacctgaggttgggagttcgagactagcctgaccaacatggagaaaccccgtctccactaaaaatatacaaaattagccgggcgtggtggcgcacgcctgtaatcccagctacttaggagactgaggcaggagaattgcttgaacccgggggccaagatcgcaccactgcactccagcctgggcaacaagagtgaagctctgtctcagaaaaaacaaaaacaaaaccaaaacaaacaagttgttttttcttagctctcaagcactggtagatgagtttccatttgctgaagttctgaaacggacgccgggcttaaatcaaattctcagaaatgtgaagaaaatgaccttagccttacgtaaattctacattgtgatcataccaaggtaaccccaaagaaacatgtttttaacagggggagagatacatacacacacacacatatatatacatatacatatatatatatttttttacacagcctttgaggggaggggaagaaaacttgaataagcctgaactgacttatgggactttcctgtcaatgatttaaattaaatctgctcttacattcacataaacagatcttatgaacacactattaacttacaagtaagttaatctgtcaatgcctcctttaaacttgtggtgttcacaggtatgcaacattgagcaaactgaatctagaaaaactccttccaatgagccttgcaatatggattcgctgggacattctacaaggaaaatcagtgtttctaagttttaggttaagagaagtgtcagaggtttcaaaggcaatctgaagagtgacagatgagctcaaagaaaggcaaagaaatcacaataaaggaagaaatggatgttaacaaatagccaagtgatttctaatatccacaatgcaaagcatgggctttactggttgcaaaaagtagacacaaagttagttttcacacccagactgactcatagagaaaacattaaattaagagttgtcaaaactcacaaaagcttccccagcatttgtagaaacatctttttatgagccaacagggggctacgacatcacaacgctgtaagaaaattcaggcacaccgggtgcacctgagtgaacacagttcttgcagttccctgggactaacacttttaagtcaacaaagagaacagtttacaagaaagctgttacattatccctgaagagcccagggcattcatagaatctgctttgcctcaggaaaaattctgtgcacagagtgcaagccagaagaaccacaattaatcagctactcctcgggcagcgtttcccaaagtgtggaacgcagaataatttcaggaggaacaaggacgcactgtttatttcaacagacagatatttattttttttataagcattagaaaaataactggctttccagtacccggtttgtgattgaagttgccgccttaaatatatttaaggagaaaaaaagagtcagtttgaattttttaaaaaatgtaacatttggtaaatagcagtacagatggtccacggacataaaggtgcaacgcgagactgaaacgtgtgcaacgccgtcctaagagaagcccctcgcccgctggcggggagcggacagtgccccgcgccgggagcttggaaagccggccggatcggacgctggcgctgagctacgtggtaaacccgggaacagttcctctccccgttctctgggcccgaggtccgcgcctacaaaacgcgtggggtgtcacaccacaaggagacaccccgagaatgcggtcaggggccgcgagacggtggcgggggacagcgctcagtacaccgctcggcgctgcacgcctggagaacgcccggtgccacgggacgccttgggcccggttcgaatcccgactgcgccactgactcgctgaggacccgcgggcgagcgactccaccgtttcgacagggggtgcgggatgtgcggctcaaccagagaagccttgaggactcctagtgaccgaccgttcgtgcacagacaggcggctgcgatgcgacgccgccgacctgcgtccaccacagagaaccgtaggccgcctcggccggccgggcctgggcctgacgggagccggaggcggccgcgccccgcaccgggcatgcgcagcaccgcgcgcacccggagaggagccgagaccgtggccgcgcgtcgagtgggccttcccgcctcagcctccccgtccggccaggccccccacaacggcctgcccgtcagccccacgcctcggctgacggccagcgcttcccggcactcaccgctaccagcgcggcgggctcccggccgctccttcgcctcaggcccgccgctgccgcctccgcgtcggcccacctgcccgccgtaggacaaaggcgccaccaaccgaccggcgcgggcacgaggcaatggcggccgggcggagagtggagatgggggcagagggcgcgcacgtagcggcaggcgcggcactgtcgcaagaccgcgcgtgtttacggcagggctgagttggggcgtcgatctccttggcaatgagggcccgggaagtggctctcgggcgggagttgagaacgcagggagttgcctagcaacagcgtcctaggctgaggatgggccccacggtggtcgcctcagcccccgccccagagtactttttttctgttttcagagcacattccctcctccctaactgtgggaacagaacattcaaatccccaaataccttgatttagtcttgcataaaactgaaagcaaaaaccccaaatccctatacacgtgtgtattggagaatatatatagtcctgtaacctccggaccacaaggaacaaagagagcagaaaggtggagaaaatgttgtatttaaatttacatttaaataggctctgtactctattagtttcactgacaagcggcaaaaggtttctggagatatagtcacaggttcttcttgagttatttattcttggaatattcgttcaacgtcaaaaatttcccggaatgtaactgttgaccgtgaagcctgtaaaatgttgtactgttcatttcatgtatagaatacatttgtcacagggaatgggatttgctcacacaatagtaaatgcactctattaatcacagccatagctatattaatcaggtactcttttattagtgttggaaacgcctcagactccatggggtctagttcttctccttgcgaatattgcctactaagaaaaaatggtgcctgcggaatttaaacactacaagaagccagatttctttgacatctacccctatgctcactccactcatttattcactgaatgtttattacatacctactatgtagccctatacttattatatgcctgcttgttaggcgctgttatgagcaaatgcagacccttttctgctatctttgagattacagtctggtgaaagcattagacgaataatcacacttgagtgtgtaattgcaaactgagataaacgctgtgatggaaagaaatagggattctcaatggttgtaactagaactttagtttactcacaggcaaagtgggttattccaattcccactttataagactgtatgaaattagaaatgaagacataaagtctgtcaaataatggatacccaacaaatgttcattcttattcctttccctccaatatagatcctaatactatgaaaatttaagaagaatcatattaattagatgattaagataaccaagcttagggaaaaatgttggtttagaggtgagtggcagtacctcaagtgggtagtggactttagccaaaagatgtattcagtgacttgtgtattaagtgtttaatgagtgttttttatgcacttgattttgtggagagtagagagtaaggtagacaaaatccttgtgcttagggagctcatggcctattagggaatatgagcaataaacaaacgataatatatagtgtttgatgagtatttttgatagaggagcaagttaattttatgaagaaagattcttgtagggaggcaggtgctcaggacttggtgacttcttatttagatgtttgctttacataataggtaacatctattgtgtgcctaccatgtgctgaatcctttacacatatcatctcatttaatcctcacaaccctattgagaggtgacagcgtgctggcagccctcacagcccttgctcactctcggtgcctcctcggcctcggcgcccattctggccgcgcttgaagagcccttcagcccgccgctgcaccatggaagtccttctctgggctggccgaggccggagccggctccctccgctttcggggaggtgtggagggagaggcacgggcgggaaccggggctgcgcgcggcgcttgcgggccagctagagttccaggtgggcgtgggcctggcgggccccacactcggagcggccggcccgccctgctggccccaggcgtgagagacttagcacccaggccagcagctgtggagggtgcgccggatcccccagcagtgctggcccaccggcgctgcactcgatttctcaccgggccttagctgcctccccgtggggcagggctcgggacctgcagccagccatgcccgagtctctccgccccaccaaccctcctccctcgggctcctgcgcggcctgagccttcctgacgagcgcagccccctgctccaaggtgcctggtcccatcgaccgcccaagggctgaggagtgccggtgcacggtgcgggactggcgggcagctccacctgcggcccagtggaagatccactgagtgaggccagctgggctcctgagtctagtggggacttggagaaccttcgtgtctagctaagggattgtgggtgcaccaatcagcactctgtgtctagctcaaggtttgtgaacacaccaatcagcaccctgtgtctagctcagggtttgtggatgcaccaatccacactctgtatctagtggggacttggagaatctttatgtctagctaagggattgtgaatgcaccaattggcactctgtatctagctcaaggtttgtaaatgcaccaatcagcactctgtctagctcagggtttgtaaatacaccaatggacactctgtatccagctaatctagtggggacgtggagaacttttgtgtccagctcagggattgtaaacgccccaatcagcaccctgtcaaaacggaccaatcagctgtctgtaaaacagaccaatcggctctctgtaaaatggaccaatcagcaggatgtgggtggggccagataagcgaataaaagcaggctgcctgaaccagcagtggcatcccgctcgggttgccttccacactgtgggagttgtgttgttctgctctttgctatcaatcttgctactgctttttgggtccacactgcttttatgagctgcaacactcactgggaaggtctgcaggttcactcctgaagtcattgaaaccacgaacccactgggagaaacaaataactccagacgtgccaccttaagagctgtaacactcacctggaaggcctgtagcttcactcctgagccagcgagcccacgaaccccccagaaggaaaaaactccgaacacatgcgaacatcagaaggaacaaactccggacacgacgtctttaagaactgtaacactcaccatgagggtctgcggcttcattcttgaagtcagtgagaccaagaacccaccaattctggacacactgtaatatgtgtactatattcctattttacaaatgagacaattgaggccagttaatttgcttgtcccacagagattatgtggcatggccagactcactgaacctgtgcggcctgatgcccaaaatgctattgtaaccacgagtgatactgtcttctgggataagaggttcccttccaaatcagggggtacctgattggtgtaaaagcctgtaacccttcagaggtgagcaccaaagtttgaccaggagataaattgaaaatctgctacagtggaggccatctgatttctgtcagatagatctttaagctcactggctgttaaaatttggtgtacagtgggttaccccttactgtaagggaagaaaggtatagtttaaagtgtggccagtactaaagaacgatgtgtgtttcctagaacatatgagtaggccttgtggtttacaggacagccaagacagggcaatgagcaattccactcaaacagcaaactggagggggcagcatttggtgctcagcaaatacctgttgaatgaagaaaaaaaaagaagaaagagtaaattcaataccatagtcaatagtggaggaatttttttgagatatcaatttggttttattttaatctggtatttttcttagtatttcagactgctttataggatgaagccagatacgttttgggtaatgaagtggtgattaaaaagtgtctaagcaatgggctcaggaatatcccaggagagagaaccagagggtctatgataaagaaaacatgtagttttttttttttttttttttaaggacaagattactgcagagaatcagaaagtaggatcagaaggcaatcttgagtaaaacccttccattttgacaaatgcagggcataatatagcctcaaaattttgatttttaaaaattaatttttttagagacagtctcactctgtcaaggcgatcaagccttgaccttctgggcttaagtgatcctcccacctctgcctcctgagtagctgggactacaggcatgtgctaccatgccgggcttttttgggtaatttttgtagagacagggtttcaccatgttgcccaggctggtctcaaactcctgggctcaagtcatcctccctctcggcctcccaaagtgttgggattacaggtgtgagccactgcaccctgctgaatctcacttttgtattggtgatgagcggctggcctaaagacctattctattttttttttttttttttgagaccgagtctcgctctatggcccaggctggagtgcagtggcacaatctgtgctcactgcaacctccacgtttcaagcaattctcctgcctcagcctcccgagtagctgggagtacaggcgcccgccccacgccctgctaatttttgtagttttagtagagacagggtttcaccatattggccaggctggtctggaactcctgaccatgtgatccacccgccttggcctcccagagcgctgggattacaggcgtaagccaccgcgcccggcccatgaagacctattctaaacgccaacagcactcagatgcagcctgagtttgcaaaaacactttcaggaatactttgcatatcatctgacacaacccaggagaggagaaacctagtacttaagagcggcagctttggtgatagaagtcagaatagaggttaactctgggggcatagactggggaggagcttgaaggaactttcaggaagatggaaatgttctatatcttgatcccatagtggttacatggaatatgtacacaggtaaacgtctatagagtcatgggtttaaaattgtgcattttactatatgtaaagtatacatcaataaaaatttaattaaaagaacaaaatgaagattttgaaatcaaaatgatttgggttcaaatcatggctctgtcccttaatttagctatgtgagtttgggtcttctttcatacatttgatatgtattgagtacctcctaggtttaccatgctagacacaaaggacacagcagtgaacaagaaagagatggtccgtgctttcacagagcttcaaccaagccacaggtacctgtcttgacaatagggataataagaccttcctcatgaggtcattgtaaggattaactgaaatcatgcatgtaaagttcctggaatatagttgatgctcaaaaacaaacaaataaacccaaacattttatacagtgtgaggaacctgatacttaggttaagtgacttatctaaagccatacatttactaagaagtcaagtcgaaaccagaacttagaacccaagtcttaattcaaagtcctataatttttcaattacaaccacattttcctgttatatctttcatttgtgtgaaaggaaagcactttacatcttgtgtactatagctaatgtttacaaagatccctgaatgacactgagatagagttgtcagatttaataaatacgagtaaaataaactaaacattttgggcctgctatggtgcctcattcatttaattctagcactttgggaggccaaggcaggagaactggttaaggccaggagtttgaggccagcctgagcaagatagagggacccctggcctacaaaacatgaaaaaactagctgggtatggtggtatgcacctgtagtcccagctactcaggaggctgagatgggaggattgcttgagcctgggaggttggggctgcagtgagccatgatcgcgcaactgcactgcagcctgagtgacagagtgagaacctgtctcaaaagaaagaaataaacaaaaattacgctttttaaaaagtatgccccatgcaatattttggacatatttatactaaaaaattagtcattgtttttctaaaattaaaatgtaactggatgtcctatattttatctggcaactctacactgaaagaatcattgaattttaaatagatggttcttcattagaagtgatcttagtttctaaaagattcacataaagaaaaagactgaaaaacatttagaggttgaggtgcttgtttcttttcttttttttgttttttagtcagggtctccatctgtcacccaggctggaatgcaatgacatgatcagggctcactgcagcctcaacctcctgggcgcaggcgatcctcccatctcagcctctcaagtagctgggaccacaggcacacaccactagtcctggctaatttttgcattttttgtagagacgcagtttcatcatgttgcctaggctggtctcacactcctgggctcaagtaagcctgcctccttggcctcccaacatgttgggattataggtgtgagccactgcacctggcctggtatctcttaatttaattttttaattattatttttctggttacatatacagggacagagattctgtgatccaacttcatcttgccatctttacccagaactttcacattacctcatttactctacacagcaaccctgtgtgatgaatgctaaatgatttaaactttaaacgttccttaacatttcaaacatacataaaatacatacctttctactcaccactgtgattaaacaaatgtaaatgcttttgctaacttgctttagaaatgaagtgatataaaaacagctggctgggcgcggtggctcacacctgtaatcccagcagtttgggaggtcaaagcaggtagatcacctgaggtcaggagttcgagaccagcctggccaaaatgatgaaaccctgtctctactaaaaatacaaaaattagctgggcatggtggcacctgcctgtaatcccagctactcgggaggctgaggcaggataattgcttgaacctgggaggtggaggttgcagtgagccaagattgtgccattgtgctccagcctgggcaacaatagcgaaactctgtctcaaacaaacaaacaacaacaacaaaaacagctaagatccttctatcaccctcatctctctccaggtaatcactcccctgaaatacattcccatgtatatttcgtactttaattttattttatttttaacagacagagtctcactctgttgctcaggtaggagttcagtggtgctattgctcactgcagcctcaaactcccgggctcaagcaatcctcctgctgcagctgcccaagtagctaggactacaggtaccaccaccatgcctggctaattttaaaaactgtttttttgtagagacagggtcttgctatgttgcccaggctggcctcaaactcctggtcacaagggatcctctcaccttgacttcccaaagcactggaattacaggcatgagcccagtcatagagtgcccagcctatattttttacttttatcataaaagatatatccataaactgtatagcgttgtttaatagtgtttagatacagtttatgtatccttttatgactttttaaaactgtactaggtttttaagatttaagtgtgttgaaacatgtaactagtttactggttcttaaagtgtagtccctggactagcagcatcagcaacatctgagaatttgttagaaatgcaaatttccactgaataactcagaaaccctaggggtaggacccagtcatctgtcctttaccaagtccttctgatgatttcgatataccctgaagtttgagaactactgatctaatttatttgttttctagtattatactgtatgaatcagccacagtttatgtatctgtactagataaacctaaggaagttaggtttttgttttgttttgatttttgtgattgttgttgttgtttttgagacggagtttcgctctgttgcccaggctggagtacagtgacgcgatctcagctgcaatctctgtctcctgggtttaagtgattctcccgcctcagcctcttgagtagctgggattaaaggcatctgccaccacgccaagctaatttttctatttttagtggaggtggggtttcaccatgttagccaggctggtctcgaactcctgacctcaagtgatccgcccaccttggcctcccaaagtgctaggattacaggtgtgagccaccgcgcccggccctgcttctttttacaaatggtgctgcattgaacctgctagtgtgtatctccttgggtacccatttcagagctttccaggatactcatttaggagtggaattgctatctttgtagtagatcacattttaaactttacaagatttagcaagattactcgccaaagaagtattatttaaagaagtatattcctgccagcagtgtataagtaccatttgtaaatttccttgccaacttttgatattttcagactttattcatttatttatttttgactacgatgatggctgtgaatgatgtatttgtggatttcattttaattttcttgaattcagcgatattcagcaccttatcctacagctctccaggtttctttctttgtgaattgcctgttcacatttctggcccatttttctattaggtttacctatggttttaaaaaattagttcataggagttctttacgtattctggatactgatcttgtgtccgggttgggtcttctctctgtggtttgtcattttactttgtcaatggtgtcttgtcattcaaaagttttaaattttaattgaaatgtttcaacattcccctttatggttcgtatgtagtgtcttgttgaagaacgtctttcccagtgtcatatagatagtctccttggtaaatactaccatgatgtcagtttggtagatgagtcaactgaggcactgagagcttaaatgacatgctcagggtcacagaccactggagatgagagacttgagctcttggtccctgggttgcactgcactccacggttccagaactttttgccatcctattctgctgcttgtttcatgagaactcttgtcagcctttttccgtaggtagagagggtgtgcagagctcagaaaggatgcaggtttggtgcagtttttatttactccataatgaagcacccataatgaagcacctggctctagactttaggatttttaaaaagatttaaattatttaaaacaacttcagatttatagaaaagtttcaaaaaatagtataaagaattatcggcccagcatactggcttacgcctgtaatttcagcactttgggaggcggaggtgggtggatcacttgaaaccaggagtttgagatcagactggacaacaaagtgagaccccatctctacaaaacaaacaaaaaaattacccaggtgttgcttccgcttggctgttttcctgcacaggagggccgtaggcacccatggcgcccagccggaatggcatgatcttgaagccccactttcacaaggactggcagcggcgcgtggccacgtggttcaaccagccgacgcggaagatccgcagactcagggccttgcaagccaaggcgcaccgcatcggcccgcgtcacgcatcggggcccatccggcccatcgtgcgctgcacaccaccctccctccccgcccccgtggttccgtaccacacggaggcgcccgtcggccgcggcttcagcctggaggagctcagggtggccggcattcacaagaaggtggcccagatcgttggcattgctgtggatccgaggaggcggaacaagtccattgctgtccctgcaggccaacgtgcagcggctgaaggagtacctctccaaactcatcttcttcctcaggaagccctcggacccccaagaagggagacagttctgctgaagaactgaaactggccactcagctgacaggaccggtcatgcccacccggaatgtctataagaaggagaaagctcgaatcgtcactgaggaggagaagaatgtcaaagcctttgctagtctctgcatggcccgtgccaacgcccggcttttcggcatacgggcaaaaagagccaaggaagctgcagaacagaatgttgaaaagaaaaaataaagcccttttggggacttgagacaagagaaaaaaaaaattacccaagtttagtggtgcgtaactgtagtcccagctgctcggggaggctgaagcaggagaattgcttgagcccaggaaattgaggctggactgagccatgattgcaccactgtactccagccagggtgacagagtgagaccctgtcgagagagaaaaagagagggagagggagaggggaagagagagagagagagaaagtaagaaagagagaaagagagagagaaaaagaaagacagaatttctgggccgggcgcagtggctcacgcctgtaatctcagcactttgggagaccgaggtgggcagattacaaggtcaggagtctgagaccagcctggccaacatagtgaaaccccatctctactcaaaaaaaaaaaatacaaaaactagctgggcgtggtgctgtgcgcatgtaatcccagctacttctgaggctgaggcaggagaattgctagaagctgggaggtggaggttgcactgagctgagattttgccattgcactccagcctgggcaacagagtgagactccgtctaaaactaaagtaaaataaatttaaaaaaaaagaatttttgaatgtccttcacacagattccccaaatgaacatttcactgtttgctctataactcctcctctacccatctctttctgttcccctctctctgactcttgtctaatctacagacttcatatgcatttcacaaatggtcccagtaatgttcttcagagcaaaagaaacactgttttttttcctagtccagaatccaatctaggatacatgttgccttcagttttcaagtctcttgagtctcctttaatctacaacagttcttcagtcttttttgtctttcatgaccttgacatttttgaagagtacaggccatttattttatagaatgttcctctttggggcttgtgtgatgtttattcattgttagattcaggttatacatctttggcaggaatgtgcagaagtgacgttgtgtccttctcagccagtgtttgttctaaacccttttgactagaaccccctgaagcattatgcgcatagatgcattttttttttttcaggcaaagggattaaaatctcttatatacaattctcagagggctcacacgacctaataagagccaacatatggccgggtgcggtggctcacacctgtaatcctagcactttgggaggccgaggcgggtggatcatttgaggtcaggagttcaaggccagcctggccaacgtggtgaa[140 bp omitted]cactccggcctgggtaacaagagtgaaaccctgtcaaaaagaaaagaaaaaagccaagacattccacatttctccttgcaggtcttggtggaagtccttggctaacagggctgtctgaaagaggctaggagacaggcaccgagagtgggtgagaagaggtttctgcatcctttacagactccacggccttctgggacctgcctatgctgccccagggaatatatctagtgtgccatgcaaacagatatcccactctccagcttccttggcccaagtatattgagggaatttaccatttatgaagtcttggtgggtcagaacacaagctgtggaatctgcatcgtccgtgttcacttctttctccaccacttcctagctgggcaaactttggctttaacctccctgcacctcacttccttcatctgtcaaagccgtgtaagaatagtcaggaggtcaggatgaagtaagttaagttaaatgaggtagcacgtatcactcttagaatcatgcctggctcatcgtgtgggctcattagctcatagatctcaccttctctaggttcacttgatgacatcacactttgtgtcttcttatagatttgcttgttctatttgttagactattcctagaaagcagaggcccttgggttttcatgggctactctgttgacagagggaataaacttcactgatcattgagtgatcattgaattctggtccactaggacattggagtgggggtagaggggactttgttgggaccatatcaagtttctggtgagccccaacagaactaatagcttctcaaagcgagattctgtaaaacacagtgaatcagaatggaactgcacacacttgacaagctctgttgtatgttgatagaggtggctcagagagttgttgaaagactaccctaaagtctctcccggccagtagagagcttctttggcagggttacctggcttgaagcccagcctcagtgacacctaccatgtcagcatagctctgtacaactgtgctagtcagaataatgactccctgaagaggtccacgccctgatctccggaacccgtgaatatgtcaccttaaacggcaacaagaactttgcagatgtcattgatcttgagatggggagacagtcctagattacttaggaacactcaatgtaatcacgagagttcttataagagggaaataggaggctcagaatcagagaagatgtgatgatagaagcacaagagggcgggaaggaaggaggcatgggccagaggagagaaagatgctacactgctggctttgaagacagaagatggggccataagccaaggaaagcaggtggcttctagaagctggaaaaggcaagaaaacagattctcccccagaccccccagtccttctgacccatttttgactttggactgtcttctctccagaagactaaataaatgcatgttttctttttctaattttaccatggcttacttttttcccttttaataattaaacctttaatccaattaaaatcagtttttgatgcatgacgtcatgagtaggtgtaattagattctttctcccttttaataattaaatctttaatccaaataaaatcagttttttttggtgatttttttggttttgttttgttttttcttgagacagtctcactctgttgcccaggctggagt[134 bp omitted]aagatggagtttcaccatgcccaggctggtcttgaactcctgagctcaagcaatctgcctggcttggcctcccaaagtgttaggattacaggtgtgaaccactgaacccagaatcagttttgatgcatgaagccataggtaagtgtaattagattctctctctcctcaaataatactgcttaaccatttttgtgtttcttatttaccgcatacattattttctacaggaggatcaagttcagggatatcaattgtttctatagctgtctctttttgaggcattctgtactgtttcaattatgttactctagatggaaatatttagatattctgtttccagaagccatgtgaagtatgcttgtgaaaatatttaaagagaattatctttgatgtaggtaagcgaatcttgtttgtgctactcaaatgaccagattaatctgattaatgccctccttcacttgaaattcaaaggatccattttccaatttgcctacaagtgttggggtatataaatagaatgtaactctaataatcatacagaaaggtaaagtaaaatgtcagagtcaggcagctcagctgagttggtggctcactgtttcctgaagatttttattcattgagtccagggtagaacttgagaatatttatttatttttttttaaaaaaaagctctctcaggtttgcaaaccactgggctggtttacaaattaaaactgcagagataaactacctaaaagccattttccacatgtcaccaactttcagggtccctcacaaataacccaaactgagaatgttaaatctcccttatgagggttagaagtagataactggccaagtcagtagagacagaatttgaagaataagttttccaaattcaaaacttagtggtgttaagtaactattttatccttattcatagtttctggaaatcagggtttccagaggggcttggttaggcaatttttcttcacatagtcttagggcctatccacgtggtctctgcacaggctgtggagagagggcttcctcacttcatggcgacctcagagcagttgtgctgctcacatgaagctcagggctctgagggagtggctaagagaaccaggcaggagctgtattgccttctatgacagtttcaagagtcacataagcctggccagattcaagggaagggagcgtagaaccccatctctcaatgggaagaatatcaaagtcccactctgagatatggttgtggccatcactgggaaatgcggtctgccacagtggagtcatctgttgcccccacatccagtgcaccagagcctttctctcaaatctttctcgaatctatccacttctctatgtacccctgcccaccactagtccaagccatcatcatccctagctcggacccctttgactgcctccaaaccagggcccccaattccacttttctttcccttcaattctttctcttctgcagctagagtgatatttttataaaacaaatttaattgcactccccattgttctcagaataataataaagctgccttcaaggccctgcgagatctgtatactttctgccttccagacttatcttatcccactgtgccccttgctttccaatctgcaaccccattggtattctttcaggtcctacatccaccatgttctttccacctcaaggcctttgtacctcccatttcctctgcttaaaatacttccccagcccctttcctacctctccccgctccctcctccctttcacctctttaactcctactcctcctgaagaatgagtctttgcagatatagttaatatggggtcatactgcatggggggggggcgctaattcaatgctggtgccttaataagaagagagaaatgtaattgaaatcttactcccctgcactcagagtagagagggagtatggcatggtagctaggagcacagactatggattcagacttcttggctctaaatcctggctctaccatttactggctgtgtgaccttggggacgtacctaacctctccgtgcctcagttttttcctttgtagaacaaggatggtaacagtacctgtctcaaaggattgctgtgaatgttggtgagttaacataggtcaaacactgagaaaaacgcctgccacttaatgctaaataagcttggctggtagtagtttgtcatcttgttgcatgctcttataggatggtgcatttctcttttctaccatttgctcaatcagaggccagataatgggacgtgaggagatgtttcctattgtctcctaatctatgactttagacccacagctgaggataaacgggtgctaaatatattatgaaccttaacctggggttcatgaacttggatggaaaaaatttactcctttattttcattgacctctaacttaaattaagcatttcttttgatcatgaatgtaggcaataaactacagtagtgttagcagggcctgctacattgtcaccaatagaaggcacagatatttctatttgatatcacactagagttgctgctgcagatgtcttgaattattgtttgcacacatcattactctgaaattatggaggttttaggcttgccactagagcttgttatttaatccagtattaaagaggcatatatatactatatcacatacttgtcttaatattttgataactatatttcaatataactggtcttctttataactctctcatattttacatttacaaagatttttctgagaagagtctgtaggattctccagatggccagagaaatctacaacacaaagaaaacttaagaatcctgttttaaagaaagtagccaacaacttgggtgaaaagctcttttaagggcatattaagaggtgagtgctttctttgagtcagccatagtgctgaggactttatatatatcttcatttaatcctcccaacacccttagaagtaggtattattatttattcccattttatagacgagaaaattgaggctcagaagagtagggatattacccaaggtcacagagtagtatgttaatggcaaagtcgtataaatcatttgagttggttaggcgcagtggctcacggctgtaatcccaacactttgggagtctgggtggatcacgaggtcagaagttcgagatcatcctgaccaacatggtgaaaccccttctctactaaaaatacaaaaattagccaggcattgtggtgcgcgcctgtaattccagctgctcaggaggctgaggcgggagaattgcttgaaccctggaggcggaggttgcagtcagctgagatcatgccactacactccagcctgggcaacagagcgagattccatctcaaaaaaaaaatcctttgagtctttgccactaccttgcaaagtaagtacctcatactttcattttacagatgaggaaactgagactcaaaaagatagagtcattttatttctcactgttaagtgatatagtcaggatttaaacccatttctgtgagactactaagcccacatgttccactgtacctggcagggttaattacaggtaccatggaaatatagcctgggagagctggtggtttatcagatacctttctatggcatccatcaggatcaagtagtttggaaagaaattattacttttactgtttttgctgtggggtgacagaactgtgcggggaatgtctttatggatgtgaaattcacgtcagcatttggaaaactccattagccactattgtctagactagggagttaaaagtaggaagcaagagataaaagaatacatgggtaggaaattctgtgttggctcatgctgaaacggaaagaatcattattttgaaaccattaatgatgaacttggtaaggatcaaagtagtctcgtgatctgtaaatctaatgaaatgaaaatgaggtaatggtatgttttataactacggaggatctgagaagctggaaattatctcagcgtgaatactgtaagagaagagggaacaatggaagccatctagaaaagaatctttattcagctttatttatagcaggtattcgtcttgtctttcaatacagggatcacaaaggagtttgtttcaccttgctgggtgtatgaaaatacaacagttgtcacagtccctgctgcttccttccatggaacttaacacgtacaaaggagggaaaggtggagacctatgatgagggggatgaatagctcaggctgggaggggagactggaggtaagagagactggggagaagaaaagacctaagagagattctttccaccatttcccaaccccctttctctaattttttacttaaaaaaaaaattttttttttacagagatgggatctcactatgctgtccttactggtctcaaactcctaggctcaagtgatccttcctccttggcttcccaaagtgctgggattacaggtgtgagccactgcacctggccccaaccccttttctctagacctgagctatctaacatagtagctaccagctatatgtggctttttacatttgataaaagtcaatacaataaaacccccactttcttggtggtactagccacattccagatgttcaacaagcacatgtagctagtggtagctaccatattgaatggcataaatatacaatgtttacatcatcacagaaagttctattggacagcacaaatcaacactccaatccacctagatgtttaggagtatttaaagcctaggacaagggaaatcccatgactgtaacatccctggcccaaaggatgacagagaatagagtctttgaaatggggcataagggtcccagtttcctgggtgaccataggctagctacttctgttctctagaactcagttttctaatattaaagagtaataccattttttattagacattatgtgagaaaatcacatagttaacttagtccttataataaccatgtgagctcttaggctcatttcacagagaagaaactagaagttaagaatatgctcaaggacacacagtcagtaacagaatcagattttgggccaggcctatgacttcagaaattacacttttactcatcgatcgatgctgcctcctgctgctagttcctcatttgtaaatcaaagtgcctttgctgtattctcccagaaacagaaactgagacaaagatttgagtgcaagtagcaagtagtttctttgagaggtgactccggggagcactgatggggtaatggggaactgagacagagaggagaaggaagccattacagggtgggtgaatgagcaggttacacagtgggcaactgtggcttcaccttgactggacagacagtgtagaacacataccttttagttatcccagctgcggggaaaggcagctgcggcattgatccaccaactcctcatctgtcattggtagaaggctgcattatctccagcccttctggcctgccctctgaagggctaaacatgctcttgtggccaaaaaaggctctggggcagaaggtcacaggtgcttgagataggggacaggaagagtgggaacagtgaatatggaaggcctgagggtggagtaccaacaaggtgctacatggggattggattaagtcctctttctgctctaaccaattagtggctagcggtgctagtactaggtattattaggtatttttacatcataaaacctgaaagcataatgactacaatctaccagagcagggatccccaacaccccggctgtggaccggtaccagtccgtggcctgttaggagccgggcgcccagcaggaggtgagcggctggctagcgagcattacaggctgagctctgcctcctgtcagatcagcgatggcattagattttcatgagactgcgaactctatagtgaaccgcgcaggtgagggatctaggttgcgtgctttttatgagaatctaatgtctgatgatctgaggtggaaccgttttatccaaaaccaggaaccatccttcccaacccctctatccgtggaaatattgtcttccacaaaactggcccctggtgccaaaaaggttggggactgctgtaccagagcctatctgtagaggagagactggagatacaattagacatctgagctgattttcaacatggatgacagagtaaagggttaatattcagggctgggattttgtctagttcacgtgacctagtaagtgctcaatgcatattagttgagtgactacatgattgaataaagttaatatgaaacagacaatttaatagaaaatggacaaaggatatatacagttagttcacagaggaggatatccaaatggttgataaacatttgataggatcctcaacttccctaataattgaggaaatgtaaataaatgcagcaaagagatctctctcttcaccatcaaatggtcaaatattaaaatgaatgataacatttagtactggggagaaggcagagtaaaggtcccttcaaacatatgaatttcccaaggtttttggaaagtatctttaaaatatctgttagcatttacaatataaatacccacaaattccttctagaaatctattgtatagaaataaaaacacacgtgcctaaccatacgtgtaaaaacattgttgcagcctgctttgcagtagagagaacctggatgcaacctgaatgtacatcaacaggaaaatggttaaattgattgtgacaagtccacaccatggaatcttacacaattattttaaagaaagaatgtgtacgatctgtatctactaacctggaattatttccatgatatattattaagtgacaaaaatgactgcaaaaaaagatagagattccttttcttattaaatgaacaaatatattcttaaatgtgtagacagatatttatcaggctattatggggagagaggtgtaaagatagataaagaaaaaaaaaatacatgccaaggcgggaggattacttgagtccaggggtttgaggctgcagtgagttatgatagtgctactgtactgcagcctgggtgacagagtgagaccctgtctccaataaaaaaaataggaaaagaaaagaaaaaataaaaataggagtttataaaggtggaaataatatacgtggtctaatattataggaaaatgtaaaatagataatctatttatgatatcccttggaaagaaaaatctgaaggtccctataggcaaggattaaaaggtggcacacgcaaatgtacaaaccaaaatgctgatttcattatgagatgggaccatggatttttttggtctgtaataaagcgcctgtttcatatttatcttgagtgggaaagtctcgattactcactgggctatggctgcatgaaaatatacagaattgtatctctagatcctgattctcaaagtgcttttttcttttccccagctaattcactgggcagaagttgccttctaatgggtctttcttcacggtctggcatttttaaggcaatcagaactttgaggatgttttccctgcattattgggccaaaaactatctgccctctctggttcttacgtttggtgtgtgcccaaaattaggaagagcaaggggaaaggagaaaaatgtcatcctgcatagagaacaacaagttgtgccgagtgttctgagggaacattgcagggcagatggattgttctggatgttcaggatgtgtacccttcttacttgaggggaaggagggcaggaggcttgacaaggaagccaaggaggcatagaatgtgcgttgtaagccaagtgtggccactctgattcctttcccaagactttgaacctcgaaggagtgatgctcaagttcaggggtagttagagattgtgttcattatctattgctgggtaagaggttgacctgaaacttagtggcttgaaacaagaaaacatctattatctcacagtttctgtgggttaggaatccagaagcaacttagctgggtggttctgattagatcaccactgggatcaatgtgtcagctggggctgaagtcatatgaggcttgactgctgcgggagggtccacttccacttccacttccactttcacttcctatgtggctgagggctggaagctttgaatccttgccatatggacttctccataggctgcctgagtgctgagtgtcctcacgacatggcagacagctgcttccccagagggcctggagacagtgcagggggtgggggagaggggagagagagagagagagaggagagaagagagagaaaggagagagagaagagaaggagagagaaagaagagagagaaagagaagagagagagaaaggagagagaaagaagaaggagagagagaagagagaaaggagagagagaaagaagagagaaagaaaagagagaagagaaaggagagagagaaaggagagagaagagagagaaagaagacagagaaaggagagagagaagagaaaagagaagagagagagaagagagagaggagacagagaagggagagagaaagaagagagagaagagagaaaaagaagagtgagacagtgcacacataagatggaagcctcagtccttttatttttatttaatttttttgtagagatgaattattgctgtgttgctcagctggtctagaactccttgctttaagtgatccttcctttcttgacctcccaaagtgttggaattacaggcatgagccactgcacctgacctcagtgggtttgtaacctaaccttgatgtgacctacactcacttctgctggtttctgttggtcacacagaccaaccctggtacaataaggaaggggactacataagggtgtgaagaccaggaggtagggattgttgagggctgtcttggaggtaggctggcacagagatggtttatagaacttttctgtggcagagtctcatctattccctgcctcctgtggttttgcctgggtgcctcccttgagccttcctgtcggctctctgggctgcccaacaccctttcaatagtgtcctcttttatttaagttcactgctacatcttctcttgtttgcaaggacaactctgattagaacaggtgctacaagagaggacagtggcgggggaggtgggtgggtagcagaggaaactcattttagataagatggtcagggaaggcctctctgaggaggggccacttaccctgagacatgaatggtgaggaagagtcagcagatgaaaggtgggaggaggggcgttttagacagagggggcagcatagccaaagctctgcggtgggaaccaaggttgccaatggccaggtcacgcagcctcttgaggtcacagtaaaaacttggatcctttcccctgcaaccaaagcatctcttcttccaaacatcagagtctgggagggctgaggaccaggctccaggcctcattgtgcggggatcagatcagccgagtaagtggctttaaccagataaggatcaagacattctctgctttgttctcgcatctgttttgccggctcttgggttttccaaatttctgcttgggttcttttctgagtttcttagttccctttgataaattcccacgtgatactggtgagctaaagggaaagctttttgtccatagttaggcctgggaatcccagctagagagccctgtcatcttatggagatgggctgctacccaggacggtgtgggaatgggcaggtgggtctgagggatcccttcagcctcattactctatagttctgcgtttattcaacaaatacctgttcagcatctggcaggtgttcagactctgtgtgggtgttaggttaagaagataaaggaggcactgttcctcctctccacaattcaagttagaagtgagggatggcctgatccaaaggcgattgagtgcaaattccttgttccttaggaatcagccacatggctggcccacagccaaagccaacaggtcctctgtaccctgtattttagggagccagatagtttccctccaggtttactaaaggaggcagaactcgctttacacccacagcccaaaattccaatttcctcttccttgcccatacagcaatcttggggaggaaggaggtccttggttttactgagtagtcaggtgttcataggagaaggccatttcctccctccccgttaagggtggggtagtggaaattcaaaggaagtccctcatggagactgagaggtgactgcaagcatggggtgctgggatgctgttccctgatgggtggtggactgtgggcagtggactgtgcctatctgagcagggtagaggagaggtgagaagaggggcattgtggtgtagctgactggatgcgtgagcttctctaggtcaagtggacgttgcagtaatcagcctggctggagcacttttctggtggcctactcaagcaggttgactgctgggcaagagggtcaggacactggtaggccctaggtggtggggtggggtaggcgaggtcaagcctgggctggatgaccctgtgagagaattgtgcagtggagaagccgctaaggaacttactcatttgcccatgagaaaccatatatggacacggggttggggtgggggtggtagggtatgtctcccaatcagaccatccgccccacctccaccaagtccttttcctcctagcaggcagggtcctggctcaagttaactcttgaatgagtaagagagaagataaaatgagatttaaattgagtttgagaataaaggtctaaaggatggaggtttaacaacagaaagtgatccaaaagtaatgcaatctgcccaaaatgtcattaagggatggaaaagggagattcaacacagcatggctgaaggcagagattaggggagaaaatcttcatcattataccccacagagttgaatcgcctcaatacactggctccacaagtaaacagaaaaattgaaatacagtgtggtcgggctagagtcttgcttgggtaaagctgccccaggttctgagagagcacagggggataggttggttgttagagagagatttccagaggagggttgcctgagatggaccttgaagggtgagaaagagttggccaggtgaaaggagagtggcagtgggaagggagctctccaggcagaggtgacagcacgggacatctggggagtggggctggagcatgaaggggaaggcaggaaggatgcttagagatgtacaccaggaggcccatggccttgcagctctgcaagcttaaggggtgagggccctggagagccactttaaaccttggagcaacacaattggatttgcatattagacagaacactctggatgccagattctggcagcgctgtggacactggacctctaggcatgctcctcacccattcacctggcactgtgaacccacctccctacaaaggccatttcatctctgagtttccaaaatcctggctccctactcttttgaatgtcctttgccccattcctattgcagaacccttcattgttccctttttgattggcctccgaatattgccactttcccttaaatcatcttctcgctttcctcctccagcacactcttctcagctcaacaagattctaggccttctctgggcctgtgcccaccagcacatgcctcctcaggatatgtatatactaaaatatcttccctttatcttatctggtcttcgccccatggggcaacccgaaggctaacatttattccttcacacattaatttaagctgctttaattgctgctatgatatgttttatataatataattaatgttttaattctgtgtacttgcttccccaggcagttttgtgaaaggcccaattttggaatcaagcaaataaagaataagtaatggctgaaatcattatagtaacacccctctctcaaaggatttaaaaccgtgcttgtttttttcaaagtatgttaaaaagggaaaagatattttaatcttctctccatcctgggcatgtttgggtggctttaatgaagttccctggaccctgatttcaagagtttctggccttttggtatctgaccaccattctcaagaggccactgcagcttgaggtctgtgttgagattaccagcttcgcaccccctgccaccaactctttgtcatgattggaggctgtacttaggatgagaagttgctgaacccactcattcatttattcattcattcagcacccatatattggtgtcctattatgtacctaggactgggatagatccagtcctgccctcagggagctcacagtcaaatgggaccaggcagaaggagttatgagctggcatgctaaatgctgtggcaacacaggggaggaggcagggtgggatagagtacctacctctgcctcagggagttggggaaggtgtaagaggaggcaacatttaaactgtttaagaaaggagaaggaaaggaaggaaacatcaagagcaatgagataaaccgtaaggaaaaaagattgtgtgcctgggaagtggggagaggctgaagccagtgtgcatgggaggacgtggcaggaagtaagcatagaaagagaggttggggctgagtgaggaagggtgtgctttgccaggataagaaatttggatcatcctgagggtgcagggaaacccaaagaggcttttatgcaggaaagtgtcccagtcgatcagatctggagtttatcaagagaatcgcagcagtgtaaagagttgcctggcacatagtaggtgctcaataaatcctgtggaatgagagaggctgttgggacagtccagatgaaagatggcaccctctgaattagggcagtggcagaggtgacagaaaataagggatggatcctagaggcagaatccacaagacttgcaaatgtgcccttaacagcagaagccatgagaatggggttagaagtgtcctcctcttccatcctccctgatctgtgaggtctggcctcttgtcctcttccagaaattgagagcttggagggtcatcacctcaaccgttgtctagttcaagctcctaagttttccttggagaaaaatttaggcctaagggaacacagtccttcagaggcagaggctgcaccagaacccaggtgttccatgctgcaaagcagagtgttaacactggttcaagaacatcttgagggccaggtgcggtggctcatgcctgtaatctcagcactttgggaggccaaggcaggcggatcacctgaggtcaggagtttgagaccagcctggccaacgtggagaaaccccgtctctactaaaaatacaaaaattagctgggcgtggtggcgccagcctgtaatcccagctactcgggaggctgaggcaggagaattgcttgaacccaggaggcagaggttgcagtgagccgagatcatgccactgcactccagcctgggcaacagaatgagactctgtcaaaaaaaacccaaaaaccaaaaaccaaacaaacacccaaaaaacaaaacgaaacaaaaaacaaaaaaacaaaagcacgtcttcagagttcatgaacccaggaaatgtaggcacaagtgtgtgtgtttctgcaaaatgagagggtcccgagtttcctaacatacttaaagtgttttatgatgccacaaaaggctggcccactctttttttttttttgagatggagttttgcactgtcgcccaggctgaagtgcagtgatgtaatcattgcaatcatggctcactgcaaccttgacttcttgagctcaagcgatcctcctgcctcagcctcctgagtagctgggactacaggtgtttgccaccatgcctggctaacttaaaaatttctttattttgtagagatgggggtcttgccatgttgccaggctggtcttgaactcctggcctcaagcaatctccctttttggccttccaaagtgttagattacaggcgtaagccaccgcgcctggcccccacctttatttttatttttatttattatttattttttttttttttgagactgagtcttgctctgccttcgaggctggagtgcagtggcacgatctcggctcattgcaatctctgcctctgcggttcaagcgattctcctgcctcagcctcccgagtagctgggattacaggcgaacgccactacatccggttaatttttgtatttttagtagagacggagtttcactatgttggccaggttggtctcgaactcctgacctcaagtgatctgcccgcctcggcctcctaaagtgctggattacaggcgtgagccaccgcgcccggccccactcttaataaatgcctgtctccaggtgctgggtgggaggtgggatggaatggaatgaggtgaggacgcatggatgcatggatgaatggatgggaagttgagacgacgcgcccacacgagggaatttcctttgaaagagagcgaaattctgagttgggaaactcttccttgaaacgcctccccataccccagctgtggccttcccgttttctgcgtggtggtgtggggggaacttcctcaggcctctccgcagtggagcctctttcggttctgccaggatacctagaggcagcggagagcggggcagggaggggaaaaccgtgagggtccctgtggcaggccccagcacccatgggatctctctccggtcgcaggaagcaggctagctcctagcccgcctcggcttggcctttgtgggacctgggggcaaagaagaagagctgtctctgggaccatgcctcctcccgtacacagcaagatgcgtccctaaactcccgggggaattagacttgtgggaatgttctggggaaactcctgcgcggtgaattgctgggggctccgcccccccgataggtggaccgcgattggtctttgaagaccccgcccctttcctgggcggggccaaggctggggcaggggagtcagcagaggcctcgctcgggcgcccagtggtcctgccgcctggtctcacctcgctatggttcgtctgcctctgcagtgcgtcctctggggctgcttgctgaccgctgtgagttgtttttgccccgaccagacgggagttgggagtggggaatgagaaggaaagggaaggaagacttcggggaagaggccttcctggctgatttttgtgggggcaggagggtgggtgggagctgggcaaggtgcccccgctcctggctgaatggggtgggctgcctctctcttctcccgggctggggtcccgggagcggcctacaggggccgctcagggaaggcactggctgcccaagcgtgcctagacggcctggacgggtttagggagcctcagaggctggccacacagagactggtagggggttcagagggcgggaagtgaggcggaccaagggaaggggcgggtctggcccgtttcctgtccccttcttattgtggacagatgccagcctctgtaagtagttatcatctccttgccagctggggctgccttcttccagggcatcttgtgggaacaagagatgggtgcagaggcccaggtacttttgtgagaaggcaaggagcttttaacatcgccttccaccccgaaccgtatcttgggtgttccaacctaggaggaatccccagggctttgcctttttctcctgaatttaagatgacataggagacccctggggagatgaacagtttatgggacacaataaagggttaggagaccagagttctggttggctctgacagggctggtgatcagagggctggagaaaccaggggtttctccaggcaccagaggggctcagagccaaccaagcatatctccgggattttcagaagcctacacttgactcactttttgtttaaatgtatttttgtagttcctcattctggaggctgggaatcccccaagtacctggctccttcatcccagcccctctggcctccccctactttagagggctgtagattcctgcctgaagcctgggcaggaatgacccatggtatcaaggaaagcaagggaagcagcaagggaagagagggagtggggaggctgctttggtcccacagctttcactttcacctgaagcaatggctcttagggaacagggaggcagggggagggcggagctggaaagaggtaaaggggggcccttgtggtaggagtggagaaagagccagaggaggtggggtgaagggtgtgatccaggcttctcaagagcagagtttgccctcataactcccaactttggctccaggtagaggctgggctgtgacaacaatgtcagaagctatctattgagggcttcttgtgtgtcaggctctgagccaaacactgcctgttttctttgtctgatttctcacaactcccccattatacagatgggcaaattgaggctcagaaagggggattgtcttgccaaaggtctcatagctagctaatggaagaacctggttgtgaatctacatctgcatgattcccgagcctgcctctcagatagtgagagtctccaagctctggtcctgagctgttttgtggcagaaggaccagaactatggggagtgagaactggagattgacagacttttaggggagcgttttatttctcatgtgtttgaagatggtatcaaggactttcctatctttgggagtgtgggagctccacgttcacaggatggtgtcttgcaatgagctggtggggggcagtagccttttctacttcctttcccattttgggtaagacacatttctgtaagtaatttgctgagatacccaggttgaatgagagccaccagttaggtaggattctggacagccagccaggtagccgggctgcttgccatatatcatgcaagcagaaacaaatgaatgatgattaaaattgccatttaatgagcacctactatgttcctgacactgtgctaggccatatacatgtattctttcttatcttcgtaatccaacctgcagggcaggcattattactcccattttagagatagagaaactgaggctaagagaagcaaaataactagtaagtgttacaaagtcaggactggagtctaaagctgtctgactctcaaacttgtgttcttttcactggctgttcccaaactgtgggacagttttaaggagcacatggacatagaattaaacatacacttactttacagttcttttaaaaatccttctcattttttcaaagaggaagtctctggagctagaatagagttaatgcctctcaaaggcttgctaatccttcttttaaaacaaaaatcaagagcaggcctgggagggccttcaacaagcaaacaaccagctgggttttaataaccttgttttgtttccccagaatttatttttagggttaccttttatttatgagaagtgatactggttcttgtctcttggcaatgatgtgaggtttacatttaaagtaaatgtaccggccaggcacggtggcttgtgcctgtaatcccagcactttgggaggccaaggcagtcagatcacttgaggtcaggagttttagatcagcctggccaacatggtgaaaccctgtctctactaaaaatacataaattagccgggcatagtggtacacacctgtaatcccagctactcaggaggctgaggctggagaattgcttgaacccaggagatagaggttgcagtgggctgagatgatgccactgcactccagcctgggcgatggagcgagactctgtctcaaaaaataaaataaaagtattgaaattaacaataagtaattaatagcatgggtggtacctggatgtagtaaaatggtgaagatgaaacacaagttgatggagagaggagcattgagacctgagttctcatttggactctgtcactgtgagactctgggcaagtgaccctcctctttggtgctcagtctcaactatctgtaaaatgaaagtgtgagtttacccttccagctttacattctagcattttatgagggaagggctggatgaacagatgatgaggagttggaggaagaaaacatgatgggctttggaaaggagcaggaagggaagcagaagaataggaggaagaggccaagtgctaaacatagccccaaacagcactgggaccagctgaagtcagccagcttcaggactccaggggagctgctggagtccccatatcctatgggatctttgggaagaggaatgactcaggcatcaagccccaaggaattctgttctgttcagagaatattgtgagtttacagtaccattgctttgtaaaaataccagaatgattctctgggtgcgattataatcagctcagttgacaatttacttgaaaacaaacatgccaaatatcatgcaggttccactttctgttttgacttgcacttcagtttgcagcctctgtcctggatgacttttacctttctgctgaagaagttgcaacggagatttcaagatcccttcaaattgcacaattctgtttttaggtccatccagaaccacccactgcatgcagagaaaaacagtacctaataaacagtcagtgctgttctttgtgccagccaggtgagatgccaaccctctagccccatcatggagtccccctttgctttggtggcagacgcagaccccatatgttaactgtaaactcaaatctgaaacgacccatttcccagccctgcttcactgtcagaatgttctggttccctctctaccaggtaaaactctgtctaccctgaactagggatcccagcttctccatcttcctcgcctgattatgaaggatccaagactttcatctttgaatcccctaccctaaagcctggcctgatcattgtgtggttagtgtctgactcatggagttggccagagccctccctcatttcctgatgttttccaggacagaaactggtgagtgactgcacagagttcactgaaacggaatgccttccttgcggtgaaagcgaattcctagacacctggaacagagagacacactgccaccagcacaaatactgcgaccccagtgcgtgcgctgttgggaaagggacgcttgggaaccgggctgatattcccgacaatgcagccattctaattttatgtagccagggtctgctctgattggttggagtccgggctgtactgatcattaaatgatttgattgccatctctacttggaagagggtctgaggaagaaagagcaggcaatgtggggagtgaggctcagagcatggcccagcagggggttcccatccttcctgcccttctcttctcagacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattggtaagtggctcatctgggaatcagttttggagggggacagaggagcttagggcccaaggtgaggggctgggcagtgggcacttagccccagaggcagaggaagcagaggctccaacctatgtcggtatccccactggagtgagctgcagacgggaccttgttcattctgccttctgccatggggatctgcctttgaagggcaatgggagaagtcctcctggggactgcagctgtcgggggcagtaccacatcgggggaagagtgctcaaggcaggagctcttcccgtcctgcctggccactggctgccttgtgagccggacaggtggtccactgtgatggttaatgtccccctccccacccactcccagctacaggggtttctgataccatctgcgagccctgcccagtcggcttcttctccaatgtgtcatctgctttcgaaaaatgtcacccttggacaaggtataagcactcatcccttgtgtttcctgctctaagagtggcatggagctgcctccattctctccagccacctgtcctgtccctgctcccagaggtccacacacactcatgtacttgtgaagcatctgcagagtggcctcatggccaaccagacaggcacatttccacattttttttgcctgctgtctctttgaggtaatagacactgttgatctctcgcttcatgagagcctcctatcttgggggtattgggacacttattttagctttccttctgcccctcctgcttctcctcagttttcctcgtcttgctttcaccttacctggctttctagggctttctgggctctgggtgctcaccctgagggcctccctctcttacctccaactccaaacccacaccaggtcctgccactggctgtctacgtgttttgggaacttactgtctccactgttgtcactttagtttgggcctcatcactgtggtctgggtgatgccttttctgcctcctggcctccctgcctctgtctctcccctcctgctggttctgtctccatcctcttgccaacatgagcgttcgacagtttctttcaaatcatgacactctcctatttgagatgcttcctgtctctctgttggaactaagactccttagcatggcacccaaccttcctgttgcatttcctgctctctttcctgcatcgcatagcttcatgctacttgcaatcctctgaacacactgttcattctcttccatcaaactcatctgcctggaataccttaaacatgggccccaggccaggcgcggtggctcttgcctgtaatctcagcactttggatgccaaggcgggtggatcacttgaggtcaggagttcaagaccagccagcacaacatggtaaaaacccatctctactaaaaataccaaaaaattagctgggtgtggtggtgggcgcctgtaatcccagctcctcgggaggctgaggcaggagaatcacttgaacccggaaggtggagtttgcagtgagccaagatagcgccactgcactccagcctgggcaacagagcgacattctgtctcaaaaaacaaacacctgccccattaactttttgcatttgatttttaaaaatgggcaagataggcacatgggacagaaggcacaaaagagccaaagtgatgtctttctcccatccctgccccttaggctcccagttctttctggagggagccattgttccttgcatatccttccagagattctacatataaacaaaccaacacacacacacacacacacaaacacacacaaaatttccctccttttacttttgcacaaataggagtatacattttatttgttaactgtctgcctttccctaatagattgaaaattccttaaatgtagaaacttggccttttttttttcttccattgatacatcccctatacctggaacagtacctgacgcatggtaggtgcttaaatttttactgataaatgttgactgataactggaggcaccactggtatagtttttttttttttttttttttttttttttttttgagacagagtctcactctgtcgcccaggctggagtgcagtggcgcaatctcggctcactgcaagctctgcctcccaggttcacgccattctcctgcctcagcctcctgagtagctgggactataggcgcccgccaccacacccggctaatttttttgtatttttagtagagacggcgtttcaccgtgttagccaggatggtcttgatctcctgacctcgtgatccgtctgccttggcctcccaaagtgctgggattacaggcgtgagccaccgtgcccggccaccagtggtatagtattaatggaatcagtgcattggcttacgtatctgattacagctcagtaagtgtgtgaccctcactgagcctcagtctcctcatctgaaaaatgggaatgaccttcatttcacaaggcttgagctaaaaacatgtaaagtgtattgtaaattcctgaatgctctactcatgtaagactaaagtaggccgggcgtggtggctcacacctgtaattgcagcactttgggaggccgaggagggcagatcatgaggtcaagagatcgagaccatcctggctaatatggtaaaaccctgtctctactaaaaatacaaaaattagctgggcgtggtggcgcacatctgtagtcccagctactcaggaggcggaggcaggagaattgcttgaacctgggaggtggaggttgcagtgagctgagatcgcgccactgcattccagccagtctggcgaaagagcaagactctgtctcaaaaaaaaaaaaaaaaaaaaaaaaagactaaagtacatggtttcttcaaagcttctctctctttctcccaccttagatgatttttcctttgcaatgtcctgtgtccattccgccccactcctcctggggccacctggaccaggtcttcatcatctcatatctatatgtttgctgtgtctcctggctggccactcttctgtaatttctcctcctctgagctctctgggcagctgaatcttctcactagtgaagtcgcctggttggatgctgatgagactgaccagctgaatccagttgaaaacttcacacttggcagtgatctggttctaaagacacaattttccatagtttcctaacaccatcctgcatgccacctgccttatttccccacatcacatcgtcccacttagcgggactgcactgctgatccaaattttacatcctttagggcccactcaggtcatatgtcctcagggaagtctttctggaagaaccttaaaccagaggttctcaacagggggcagttttgctccctgtggaacgtttgccaatgtctggacacatttcattcgtcacaaacggagagggggatgctacagggatctggcggatagaggccagggatgctgctgaacatctgcaatgcataggacagcccacccccacccccacacccccagtaaataatgatccagcccaagtgtcactggtgctgacgttgagtaaccctatcttaagctgaactcatcatctctccattccagccttggtggattctgtctcctctgaaccattcccatctcactttagcctacctagatcacaaagcttggcactcattatagactcccctatttattactccttcaagatgtgcaagaatcttttctctgcacttttaagttctgtaagaagagtctgtgtcgttcctataataaccagcataggacgttgcacgtgttgtgtgctcagtgaacctggatttgttgattgttgactgactcactctagagttggaaatcttatgcttggggaaacttaatatctctttctttctctgtgtgtgtgcatttgtgcacgtgtctgtgcatagctgtgagaccaaagacctggttgtgcaacaggcaggcacaaacaagactgatgttgtctgtggtgagtcctggacaatgggccctggagaaagcctaggaaggtgggaactgaagggggagatgaggcacacaggaacactggatgggaaaaaggggaggggaggcagtttgggggtgtggtatcacagctctgccacttatcttgggagtctgggcaaatcacttcccctctcttagcctcagtttcttcatctgtaaaatgggatgataacagcacttccttagtaggttttgattttagagtgagaaggttggcctacagtaaagatcagataatgtaaatcagtgaaaaaggtcaggggtaagaaaattacattctctttacctaacgctaaatgaccagttaatgggtgcagcacaccaacatggtacatgtatacatatgtaacaaacctgcacattatgcacatgtaccctaaagcttaaagtataataataataaaatttaaaaaaacgaaaaatacattctctttgctttttctcaaaatgtactttcctctttgtagggctgggactagaatgaggtgagcaaggcacttgccctcgggcgcaatatttaagaaggtgccataaaagtgtagtaatcaaggtaaattcattttgatgcaatatttttaaaaataaaaattaatgcaaagaaatccatgatgagcaagatagcaacattttaaataaagaacaggatccgaccctgtgtttgcatgaccctgcctcactcacctcaccctaatcctggccctggttccagtaaaaggaataggcagccagcctgcaggccgtagtttgctgacttggtgtccgcctgatgattttcaaaatatggcattaaaagaatgtttaccttgatgactgagtgttttggacatccttttcaattttgtcctgaaacaatttcatcccttgcctcacgctagtctccgccctgccttttggtctttcttttattttcccactttgaaaaaaaaattcggcatgagaaatactttacctttcccctccactcttctataccaaaagcaacatgcagacatgaatcatgctagacctcggcattgggcagagagcagggagtggcggggagcatggtgagcaggtggtgacagccactgccaccactcgcttctagatggttcccaggtggggaggctgccaactggaacccagtcttcccagtttgtaagagaaatcagatgtctaggtttgaatatgtgatctcccagtttaaaaatgtcggcaaatatttccaaacgttaagaaaatgttctggctcctttaaagacatctgccagccacatttccccaaggaccgcggtttgaaccttctgatgtagatgagctctgacattggaagattctggagtctgacaagtcacagcaggttgagggtagggagaaactgcaggtgaggggtgcatgctgaagtcctgatttctccaggtccccaggatcggctgagagccctggtggtgatccccatcatcttcgggatcctgtttgccatcctcttggtgctggtctttatcagtgagtcctcaggtggggaggtgttgggggagggaggggagaccacctgtttcttatctggcctctccaactccccatcctttttttttttttttttttttttagaaaaggtggccaagaagccaaccaataaggtaggtcacccctgagaacccgggacagagttttgacaaactgggaagatggcctcacggttgcctatggggcagtaaaactgattcagagtctgtctctgcagccagtggggtggcagcagaattggggactgtcatccccacccaccatgctccttccatccagagctcaatcccccacagaactgcccctggcaccactggcagagcctaacactggctgttcttcactcctttcctggcattcaacgcgtggggagctgcatctttgggccttggggctgggtcaaatgggtgggagcaaatgtggcagccccttaagcccactggctcccactctggaagctcttcgtcgcccttggtgtggccagcagggggcaggaggcacccgaggaatcagcactgacccgccgtctgggaaaggggggagggcttggggaagggatccgcttcccagggaggggctcctcagaggcacagctgcccctgctgctgggggtgacctcacaccttgcctctccaggccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtgaggctgcacccacccaggagtgtggccacgtgggcaaacaggcagttggccagagagcctggtgctgctgctgctgtggcgtgagggtgaggggctggcactgactgggcatagctccccgcttctgcctgcacccctgcagtttgagacaggagacctggcactggatgcagaaacagttcaccttgaagaacctctcacttcaccctggagcccatccagtctcccaacttgtattaaagacagaggcagaagtttggtggtggtggtgttggggtatggtttagtaatatccaccagaccttccgatccagcagtttggtgcccagagaggcatcatggtggcttccctgcgcccaggaagccatatacacagatgcccattgcagcattgtttgtgatagtgaacaactggaagctgcttaactgtccatcagcaggagactggctaaataaaattagaatatatttatacaacagaatctcaaaaacactgttgagtaaggaaaaaaaggcatgctgctgaatgatgggtatggaactttttaaaaaagtacatgcttttatgtatgtatattgcctatggatatatgtataaatacaatatgcatcatatattgatataacaagggttctggaagggtacacagaaaacccacagctcgaagagtggtgacgtctggggtggggaagaagggtctgggggagggttggttaaagggagatttggctttcccataatgcttcatcatttttcccaaaaggagagtgaattcacataatgcttatgtaattaaaaaatcatcaaacatgtaaaaagaaaaacgggggtgaacatgctgggtgacatgagctatttaacctgctgtcaggctcacggaatgagggcattttctgtagataaataagaatgtccccaggctgctgcccctccagggtggtttccatgtgtgctcacatgtggtattgagattgcaaagtgctcttcccatttgattcatgttcacaaaaatagccttccccagcagggtgggtctgcatccctccctcttttacagaggtggaaatgaggtccagagaggcgaagtgacttgcctgtggtcacacagcggtgtctggtggtgccatgctcagagctcctcactctgggtcctgagctcctcccagatctgcctgctgtctggaactgacatctgtagctccttcccagggagatcctgggtctctcaccgccttctgacctccctgtggctgcaggagctactgcttctcggtcagatggtatccccttcccccaagcagtatctcaggataaaaataaaccatcctgttctcttttcctgctgagccaactgagggggagcctagccaggaggagcggcagatggagtgggagcagaggggaggggaggggaggaaggttggaggacaaggaggagaaggaagagcaatgcaaagtgccatgcagaaccccggcacaaaggttcgaggtgaggtttaacccaggggtctcagcctttcccaggaaagaacctgctttggatttccccaacacatcctgctggctggagggtgtggggcgatggggggcaaggggagatgtggagagggcttatcccagtggaggctgtgagggcagctgcgagccaagagaggggcacctggcttggcaggcttcccagaagagcttcaagaaccatttggatacaccaggtggaggcctttggtttagaaagtggagcaaagtggtggtggcggggaaggggaactttgggacctaattcttgtctcttatctagagcctaagagtgagtgttgttcacttctttggtggtatggtggaaagagaccaaagacccacgcctgccacagatcatctgtgtggccttggatgagtcactttcactgcttcacttctcagtttccctatctgacaaatggtgacaatatctgcagcagacgctattgatgcctcctgtgttctcttctaggtcagagcttctcaaatttgagtgtgggtcaggcgcagtggctcacgtctgtaatcccagcactctgggaggcttaggtgggcagataacctaaggtcaggagttcgagaccagcctgaccaacagggcaaa[134 bp omitted]ccactgtactccagcctgggcaacagagtgaaactccatctaaaataacaacaacaacaatagcaacaacaacaacaacaatagcaacaacaacaaaacttgagcgtgtatctggaccacctgcaaggtggtcctctccactattttcagaactggaaggatccttagaactcctagggacccatcatgcatccgggaacaaaagcccagaactgagtaactttcctgaggccacatagaaagctcctggccaatctctgtttagaaccagaacgtgctaacgctgccaagaataaccacctcttcttgttaaagatcgtggggccccacctcctgtgtttctgattctgtgggtctgggatggagatcaagaatttgcattctaagaagtttcccaagtggtattgatgctgccggcccagggtttatacttggggaactactgccttcatatttctttctttctttctttctttcttttgaggtgttgtcttgctatgttgcccaggctggagtgcagtggtgccaccccagctcactgcagcctccatctcccaggttcaagtgactctcctccctcagcctcccaagtacctgggactatgggtgtgcgccaccacgcctagttaattttttgtatttttagtagagacaggggtttcaccatgttgtccaggctggtcttgaactcctcacctcaagtgatcctcccgcctcggcctcccaaagtgctgggattacagggtgagccaccgcgcccagccagcattcatattcctatactgtgtaagcagccagtttctgactgcaagcactggggatcacttgcctcagggcttttccaggtcttgaaaacatgcttggtgcagaggcaggccaggtaagctgtagatgggggagttaattccccgaagtactttcagccagccaaggttgaaagtgggaggataaatactcaagcttccttgcccttgggagggacaaatgtgagctgtgttctacagtgtctccgaggctccctggagggactgagctatggaacctacagtgggcactctgcactgattcccatcctttccctgtctcacatcccctctccaccactggtgcttcccgggttcaactcccaaataaacgacctgcattcatccctagtctcaggatctgcttctgggagaagttccccctgagaatcagcagagcccatgcacaacaatgtgcaattttgtttttcttagcgtccctaatgaagggaagaggtggttattcttggcagcgttagcacattctggttctaaatagagattggccaggagctttctatatggcctcaggaaagttactcagttctgggcttttgttcccggatgcatgatgggtccctaggagttctaaggatccttccagttctgaaaatagcggagaggaccaacctcttcagggtgtagggtcctgcccggtgcgtggacggagggggtggccgtgaggcgcgcatcagccagaaggtggcgccaaggtaacgcccgaagaccctggcggcggcttgggctccctgagtaaagttgggtttgctgactcgccccacacccgcccacacttggaagaggagacctttcttcccttgaccccatcagcctgagcctcctgaagcttctactctgcaacttcatccattcccaggtctcatccttgtcatgaatacttccttccttaacaaataccagctgcggtcccactgtgtgccccatccggagctagggttgtgcacagtgacactgctaagacactgagtgctcactatgtgctaggcacagcgctaaggactttgcatgcattgccttaatctttatgacagccctgcgtaagacgtggtctcttacaatatactttttacagatgagatgcagaagtcaaatgacttgctaaggtctcgagagttagagctggaatttggacctaattaggttgactcaaaagcctgaggtttttgctcattcagtgagtaggaaagtaggcatatgttgcggggtgatgtaaactcatgcccgcaggggctggagaaagggctgggagtcaagtcaggtggcagacgctaggcaaaatggagaggctctgcccatctttgggggacagcctccattggctccttccaatggttgccgagcaggaatgagggttgcagattgtctggaatctggatttttttttttttttgagacagagtctcgctgtgtcgtcgcccaggctggagtgcagtggcatgatctcggctcactgcaagctccgccttccaggttcatgccattctcctgcctcagcctcccgagtagttgggactacaggcgcccaccaccatgcctggttaattttttgtatttttagtggcgatggagtttcgccatgttagccaggttggtctcgatctcctgacctcgtgatctgcccgcctcggcctctgaaagtgctgggattacaggcatgagccaccgtgccaggcctggaatctggatttttatgtgaactcttactatttttaaattccaaaaattggtcaaaaaatccacaaaagtggccgggcattgtgctcacgattgtaatcccagcactttgggaggctgaggcaggcagatcacctgtggtcaggagttcaagaccagcctggccaacatggtgaaaccccatctctgctaaaaatacaacaaaatttgcggtcatggtggtgcgtgcctgtaacccctgctactcaggaagctgaggcaggagaatcgcttgaaccctggaggtggaagttgcagtgagccgagattgcaccactgcagtccagcctgggcaacaagagcgaaactctgtctaaaaaaaaccaaaaaaacaaaaaaacccacaaaagcttggtgagagcatgggaaagcatgtcacagacggctgggattaaaagagactggaaacttccctgtgtcctatccttttgtttttatacgtggggaaacagaggcactgagaaagtccagagctggctcaggcaacatgtcctgggcagcttgtctctctctgtgcccagccaggagttgaagagcccctgggggcttaggatccaccctgtgcaccccaggtaaccagggcctaaggcactgatgctctgggactgagggacttcccttgggagaggcctagttgtgtgtagatgtcctcctcattctatgaacagtcccccgacactcccacccgtgcagccccagccacaggcaggaacacacaccagctctcccacttaagccttcaggccctgcagtcaattcctcgggcagcagaagttattaaagaccctgcccccaaggacttctctcccaccgactgattctggcacagcaaattacaaacccatctgtaggggtggggagatgcagttttaatttgtaaaaacaaagaaagaaaaaaaagaaatctatgctgtggtcctggagttggggaaatggaggaagctcctgagggggctcctcctgggatgagcagtatggttaccgtgggtgctccaggagaagcccagcaaggtcggtgagcagcttgggcccagccagctacagccagtgggcagggggtgagggcgcctctctcttcctatgctcgccctcccttcctgtccctggggctccctgctgactggcacatccctctgggccttggtgcccagctagttctctgcctcccgctcactccagtgctccttcccatcctctgcagcatctgcccgcaccctccttcctgctttctccaatgctttctaactacctcctttcccatctccagctattccgactcaccttgttctcttttgaacaagtgttattattctgcctaattataaaagtcatgctcatgcaccacacccctcatccaagcaataaacaggaccagggaagtaagaccacttgtaaacctcccaccccctgctaaccacaagatatgggtccttctagacttgttttctctgagataaacatttttttttttaaacttgggctattattatatgcattgttttgtaagcagccttctttgcttagcagtgtacggcagacgtctctccatgccaattacatagaaatggacagcatggctttttttttttggtctcactctgtcactcaggctggagtggcacgatcatggctcactgcagcctcaacctcgtgggctcaggtgatcctcccgcctcaggcccctgagtagctgggactacagggatgcaacaccacacctggctaagttttgtgtttctttgtagagatggcatttcgccaggttgcccaggctggtctcaaactcctgggctcaagtgatccacctgccttggcctcccaaagtgctagggttacaggcctgagcaactgcacccagcaacagcatgctttttaattggtgcataggattccactgtagggctggatgctgattcatgaagaggctccatgaagtccctcctggactttcaggcagtgtttctctttccttttcctcatgagtctctccctggtgcctcctccgcttttcctctctctccatctcttcgtctcctacctcccattttctctccacctttcactctcccctcctctctgacttcatccctgagtccccacccttagtttctcctgtcttctcccctccacaccccactctccccagccctacccattccctctgactctctgctccctgcggagggtggggggtccatggtgtttaacaccggctcccacatcagacacgtgccatctcattagcgtgcctgtcccccaaagtgaggcaggcaggagccacagtagcagcgagaggcctaattgaatgtaactaattattcactcccttaaatgggcctgggagggacagaattactcactctgaactggggagacagggaactggccgctggcaaacaaatcctggggcctgtggagagggctctccttggaatactaattagggccgagtgatgggataaaatcagggacagagacgcctctccctgccctcccacctcgtctgggaaattgggggtcaggaggaggaagggactcttgtgtgaatctaattgaaggacccctgggaagtgttaatacggggtgggggcaggggaaatgaaatgctgagcctggggcttgaggaaggcagggggctaatgtttaatatggagagaggcgggagggcacagcagtgcctgagggaaggagctggcagcaaccccagagccaccaagagctgagggaaccccactggctcctgggaggaagcccttctcctcccaagcactaccaagtgccaggccctgtgctaaagaccggtgttccaaatcttcttgaagccctttgtgtgttggctcactccgtatctcagatgagaaaaactgaggctcagagaggggaagcggctccttcatccatgatcaggcagctagaacatgcagggcggggcctcggttccacctggctgcaaagcttctgttcctaacccctagaattacccaggccacatcccagaccaattagataaaatttccatggaggtggcatgtgacggtcatagtctaggcatcagtatttttttttttttttttgagacagtcttgctctgtcacccaggctggagtgcagtggcgcgatcttggttcactgcaacctccacctcctgggttcaaacgattctcctgcctcaatctcctgagtagctgggatgacaggtgcccgccatcacaccaggctaacttttgtatttctagtagagacggggtttcactatgttggccgggctggtcttgaactcctgacctcaagttgatacatctgccttggcctcccaaagtgctgggattgcaggtgtgagccgctgcgcctggccaatcatcagtatatttttttagagcttccctggtgattctgagattcagccagaactgaggacccctggtctggactttatttccctatttgagtcactgcttctatttcacaagtggcatccatccttctactgagccaacctgtcccaaaggacctctaggctctatctagccttatctctgggactggtttccagacagctgggagcacgcaagttggggcaggagggactgtgtggaataggatgagggagggttctaatgtccaggggtggacccagggtagaagacctgaatgcagccccaggagactctgggatgcatcattctgggcagctcctgaaggtcaaaggtgagaagtcaattagggattgtgcagatatgaaaagaaggacaaatcacacgatggagagacgtatagaatggagaggtatgtgtgtgtgcatgcgtgcgtgcacgtgtagtaagggagtggttggtgtgggtgggtatagtaatcgtgattcttgataccatttatgtgccaggtgcttttcccatattatctcatttggtcctgacaacagtcctttgaaggtgtatggtcatccttgcagctgagcaaggtgcagctcagaaaggttgagtaagcgtcccaaggccacacgcagaaccagtattcaatatctggctcccagtttcaaatcccatgctcctttctcctactctgccttgattgtgctattgcacttgtgatctcttctctagcaggtgttggtgtgtgtgcatgctggttaggtgtgcatgatgtgcgtgtgcttgtgtgtgtgttgctccctccttttgggagggacaaaacttccattctgcccagcacaatgcctcctgctgactagtgagagggaagaggaggggcacccactcctgcttcttgcccctgttccccagtgccactcagctggtgactgcctctcctgtggctggggctgaggaggggcggggcaaggcgggttatcctcccagccaagtgacaaatagccttatttgtaacaaaggtggagagacaacctatttctagggtggggaaattctctctttttcaggctttcaagctgccctcctgccaccccatcccctgccccagtgaaggtggcagggagagatgggcctgtcacactcattccccttccgttccgccacctcaagtgcaggggacttcatgggagcttcatagaggggcagcaaatttatgagcccaacaccgattccccgatcacctcgctggccaatccatctttctggagccagagatgaaatgaaattattgtgaaataaatccatacagatgatcgagggactggcagcagggggacagcaaggggtgggagccaggagctggggctcaggtgggagggctattgccactccccttggctgagacccagagaggggacttcactggctttccttcctttgatggggtggggctgcgttctgcttatgccaccaactctctatggagcctcttgcccaataggatccttatctaaggggctgaatgaaagaccctccagcttgtgatgggtcctgtgtcactcatgcttccaaactcccagggtcagagagcaaggagggagtgggaggggttgcattcagggtgaggtgggagtgaagacagagtcagagtcagggccaagggcctgggtgatgcttcccatatttaattacccgccgtggaggccccctgctgtgccaggtgttcgtgcctaagttttgggaatgaagggagacccaagggaaggcaccagtgttggggttactcaggcagcttggggccacagctgtttaccaggaggtttggaagtagttcaatattttaacaacctctgtagtaggacttcatattccagctgagttccgatcttggagcagggcgagggttggggctgcttggtgccctctccctcctctttgcccagcagtgtctgggatattccccacaaagatcctgcaggatggctgtgtctcaggctggtgcatcaggggctggcctcagagccaaagggtccacagtggacttgccaagcccagagtgccagagctttcctgcctcccctcccactttagccagctctcagggggccccccaccaccctgagcactgagctggaattggaggcagccagccggctgggatgtgatcattcggcctcctgagcaaggccagccctggccacagggaaacaatgaggtcccttgagtagtcaagggtctgctggggccactgggcaggacaggccctccctagcctgccctggtcttgctctgggaccttgaccctctccccttctgaggaaggagtacagtggctttgggggatgatgaaggccagacagccagaccctcagcacctattgatgttgctggctgggtgggtgtgtgtctgagtgcagccccgggctcacattaggtggggcgggggtggaagccagacatagactgctctggaaatgagatttgcctcgttatctgtgcttgctcagaccgagggccttgggcattagccagcccatccaaggagttaagaagcaggaggaggggcagagagccgaaatccaggctccagtggatagagcccctgctggaatgtgtgtgtatgtgtgtccctcggtggtttggatttgtggggttttgtctacaaaagtgtgtgtgttttcctggttagtgtggatgtcctttaaaagaatgtgtgtatagcactttgcctcctgctcatggtggttgctgtttctctttagtgtgtgtgtgtgtgttgctggaattaacacaagtatgtctgtttctggactgcacctgtgtgtgcacacccacaggctcctgttggttttgtttgtacatgccctgttcgcatcccagcccactcagaaggctgcaggcccagacacagcctaatggacagagccaggtgggcagggcaggctggctggcctgcacccagggggcggtgggtggatctgggcatcttccagaggcaccggcctggcagggaacaaaggggcaatcagtagagaggccactagagcacagctgattgaggaagaggaattaactaggagccccatggggctctgcagggggcgggggcggtggcccctggcattctgattaggagggggagcaggtgcagctgggcttacctgagccacaggaaggagttggagggggcagaggggaaagcctaggatgggatgaagtagagcagagctgggagctgaggacctggaccaatgactttgagggagaggagcaaggggtcctgggtgagaaggtcacagagtgtactgagcagatattgtcatcctaaatgggatccttgtcacctgtcatcctaagtggatcacactcccacttatccagagcttgctgtgggcctggcaatgggctaaacatctgccatgtaatcctcacagcacagaagccagttccatcatcagtcaggctcacacatgaggatgtggatgcccagagaggtaaggcaacttgctggaggacacacagctatgaatccaggtcggctcggctttagggtcctcattttaacctctatgccaccttgccactccccaggcctctgctgcattgccagtggggagatgctacaggaagacagactgtggcacagaaaaagagggatgtacaaatccacctgaccaaaaaagcagcctgatcctggagggggtgaaatgcctgacactggaggtatgcaaggaatagctcactaacaaaggggttccttgctggataggtggttggattccattctctccatcattgtaatatggattgagtcagagtccccgggtttgaatcccagctccaccatttattcactgtgtgatattgggcaacttgctagacctctctgtgtttcagttttctcatctgaaaaatggaggagtgtgaggatggagggtcagagagagctgggggaagaggtgggacttgggatgaacagaaagcaaggtggcaatgcaggtgttaggctctggggcttgaggggttgagtggggttcaggtgaccttaggttcagcttcctctgctctagcccagacctcacatctctcactggggccattgcttcagcctccatcctgcttttcgtgcccagcctctcctcctccggcccattctctgtcctcttcaatttgaccatgtcactcccctcatctgtagcctttaatgactcctctccccctataaaagtggttttcaaagtgtgtcaggagaaccccctgcgggttgggggataaccttaggtgacacatgatccaggtctcctgggagactttgcacagttctcttttgatcccaaggaggacaccccagtttggtgctggtttgtctttcatatcctttgctgtaggaagatcaggtcagactcggccaccagcaaacaactgagtctagttagaactcaataacgctgatttgttctaagctttgatttctacaactgtttccttctcaaacaccttctcctctgggctccccaatgctgcattttctcatttgccaccctgcttcactgcttgctcccggcaggtctcctgttttgctttttctgctgcggctggtcctctcaacgcaagtgtactatcaggctctgcctcattcctattcttgtctggagctccatctagtcccagagcattaaccactaccactgattctcaaatgtaactctcgacccagatcaatttccagctgccttcctgatatttctatttggatgtccaataggtatttctaatctacaagtcctaaacggagcctgtgctacccacgcctctgcctctccccttgcctgccttgcttcagtaggtggtcacacatctaggagttatccttgactcctctctcttctttgccttccccatccaatccattagccatgcctgtcaactttacctgcaaaacatattctggaatagccaattcccttcatgtcctcatgccctggtccgagccagcatcacccctcacctgcaggctgcagcagcctctgggctgatcatgccgctctcaacttgcatccctccaaacctaccacacggcagctggaggatcttttaaaagcattaatcagattacatcactcaactgcttaaaactctcaaagggcatccccttgtgcttacaacaaatccaagccctttgctctggtttataaggtgctgtgtgactggggtttttttctgtcagtttctcttactccatccatatccctctctcccttgctcactctgctctcgtcacattgccctgcctttgcccttgaacctactgagctcggtcccactgtgttccctctgcccagaacttctctcccttgatcttctcttcctttagctatctgctggggggggggtcacttcctccgagaggccttccctgagtactcaacaataaagccactccagacaccactgcatccctctcttcttgctttttgctgagcatgacaggtttttttttttgctttcctccatataattacaaactccacataagaaggaatgttacctgtcttgttcattgctgtattttcagtgccaagaatggtacctgaatcatagaagatgattattatttgctgattgaattaatgagttgtattttttacagttacctttgatgtatgacaggtgtcacttttttttccattttagatggtgacataggtttccttttaagaataaagcaaaaaaaaattctgataagagacttgaatatataaggaactcttataactcaacaataaaaagacaaatacaatgaaaacatgagcagagaatttgaacagacatttctccaaagaagacatacaaattgccaataagcacatgaaaagatgctcaacatcattagtcattagggaaacacaaatcaaaaccacaatgagataccattgcatttcaaactacaatgtgattatcactttactagaacggctaaacctggtgaaattggaatgcttgtacatcactggtgggattgtaaaatggtgcagccacttaggaaatagtccatcagttcctcaaaaagttaaacttggtgttgtcacatgacccagcaattcctttgcttggtatatacccaagaaaaatgacaacatacgtccatacaaatacttgtacacaaatatcgatagtagcattatttaaaaatagtcaagaagtagaaaaaactcaaatgtctgtcaatggatgaatggctgaacaaaatgtggtatgtacatacaatggaatagcatttggccataaaaagagatggagtactgacacaggctgcaacatggggaatcttgaaaaccgtgtgctaattgagagaagacattcacgaaaggtcacctattgtatgattccatttatatgaaatgtccagaatggacaaatccagagaaaaaaaagtcagtggtttccaggggctggggtagggaagaatgggaagaggctgataaaaggtacaggatttctttttggaggaaatgagaaatgttctgaaattcaatagcagtggtgcttgcatgactctgtgaatatactaaaaaccactgaattatacattttaaaagggtgaatttggccgggcttggtggctcatgcctgtgaccccagcactttggaaggctgaggagggagggttgtttgaggccaggagtttgagaccagcctggacaacatagcaacacctcatctctacaaaaaaatacaaaaattagctgggcatgctggctcacacctgtagttccagctacttggaagactgaggcaggaggatcacttgagcccaggaggccaaggctgtagtaagccatgattgtactactgcactccagcctgggtgacagagtgagaccctgtctcaataaaaaaagggtgaattttatactatgtgaattatatctcaataaagctgttataaaaataaagtgaagaaaaatgataatttaaagaaaaaggccaacagccccagtacagggacacatggatctttggcaaagtcatagaagactcatgtgaatgactgaagttggtttgtaggcttataaggataaactgcagacatcctagtttaacattgaagacctatgcttaactctagcttcgtgtgctgccctttttaaaatgactatgttgaccttatccctatttctggaacacttaggaatctttcaagctgctttgtctttgcaaattttgggccctccctgggatgtcccttctccttttcttcatctggttgaacccaagtcaatataggtgggcttgataggggatggggcatgtgccaggcactgagcttggtgctggtgagacagtgcagaggactaagacagatatggtctggggccttggctggctcccagacagggtgaggagacagatgaggacctgccacacccacactgggctgcaggaatgcagtagaagaacctaacacagcctgagagatcagagaaggcttccccagaaagggacgcttcagctgagtagttggccaggcaaagaagaggggaggagtgccccagatggagggaacagtctgggcgaaagcctcaagacagcgcgcagcaagttggaggaatcctcagaaggtgggtgtggctggaacacagcccagaaggtggtgagtgctgagaaacggtcctagagagaaagccggagcctggggatcagggccctcataggccatgccaaggaatctggatacttgcagagctcagttagattgcatacaacgctagctgggtgtggtggcgcacccctgtagtcccagctactcaggaggctgaggcaggagaatcgcttcaactccagaggcagaggttgcagtgagccgagattgcatcactgcactccagcctgggcaacagagtgagactctgtcgcaaaaaaaaaaaaaaaaaaaaaaaaaaaaagattccatacaactccaaatgatggctgtttgactattttttcttcacatcacggatcacccctgccgttatacatccatctgttgattgtctttccccctactagaaaggacaaggactttgtgctgttcactgctgtgtccccaacagccagaagagtgcctggctcacacagacactcaataaatacgtattgaatgcatgactttactggcctgtgtcctctgcttactgagttattgaaagtcagggacctgttggattcatcattgcgtccccagggcctagcacagagcttgatgcacatgctgtttaataaatattgaaagaataaatgaatggaaaaacgtcttccccaatgtgttacacactcccgcagggccgggactatttgatttatgtatctagcgcccaacacattgcctggcagaaagcagaccctcaataaaggtttgttgagctagacaagagtctcttctgcatgcgggcccttgtcaggcctgtcatgggagctcaaataaaggcaaccagaccctatactactggatcaggcagaaagagataccttgttggcaaaggatcttaggaccctggagtcataggctgtgcaggcaggatcagcctgcatgtgtagggtggccagagagaccaaagagggcttcccgggggtcaggaatcctgcctttgtttatgtcccctagcactgcccttctctggcaactggcaggcagccccaccaatgaggtttgggcacagctgggggtggaatgggatgggacagatggtgggagacaaggaaacccccatgttttcctccatctgttacatttaattgacttcccgcagaaagaaaaaaaaataaaccagttgcaaggatgaaattgctaattaaaaggccctctgattagatagacaaatatttaccaattatgcctgaccctgcctgtccccttttacgtctgcgaactcccccatcagcactgtggccacatcatacccagctggtggctcttccaccaatcactctcttggggctcagactggctgcgggtgaaatagggtagaagaaaggtgaatactgcaaacagccgttcaacaaacgcgatgcctgttgcatggtcaggcttagtgctgggcccctggaagccatagcagaatttccatggacagcctttcaagttgtgtgctgcacaaaggtgcacctgcaggagagtgggggctccccctgtcaacctgggacccctggcaccaggcaagggggatttttattttctttgcgcaacgggtcattagcttgccaagctgaatccacaggattttgcctgcccagagggggtacctttttctaattcacacagaatgggctagtggcagctctacagagatgaagatagttcagttcctgatcctcaagggctctagggatagtgggggagaaaaatatgcctatgatgtataaacattcatgtgtgattttttttcttttttcttttcttttttttttgaggacagggtctcactgtgtcacccaggctgagtgcagtggcacgattacgacttgctgcagccttgagacccctctctccccagcagcctcctgaggagctgggattactggtgtgcatcaccatgcctggctaatttttcattttttgtagagacaagatctctctatgttacccaggctggtctcgaactcctggatgcaagcaatcctcctgcctcagcctcccaaagtcctgggattacaagtgtgagctaccatgcctggcttaaacattcattcaataaacatttcttgtttactggccactaatgtttgccaagcactgtactagattctgggagagagagagatgagtaatatatgtttcctgccctccagaagccgggctatttgggggagacagagatacttacctgggtctgcccttcctttttccccttcccttttttaattccaaataatcttcacctgggaggtatgaataaccgctctggactctcaccattcaaatcctggctttaccgtgtcttggctgtgtgaccttgggcaagttatctcacctctctctgcctcaggttgcctctctgtaaactggagataatggtaactgcatcccagggttattataatgattaaataaattagcacatggaattcatgcctgacacggagtgctcagtaaaggttagctattgtgtgactgtttcttttttttttttgagtgcctactgtgtgccaggccctgagtcctggggatacagaactgttaccagttcatttcctctcccttcagagctcacagtgcggaacacacagagaaacccaccaacacacaggcaggctcacacatactcaggccttgctgaaagaaagttgtggtggcagggtgtggttctagaatgaatgagtcttagcttggaagtcagaagatttggggttgtcttaagtccaagatagggaaacggaatgattgcctggtaaggtaacgatctctacatcactggaggtatgtaaaccaaagtgtgaagttgccagagagaggcatcttggctgtgggagaaaagtaggtcaattctggtacgatcgtcccctcctgggacagtgagacaagcttcccaggaccagctggggagccctagagaagcccggcactggcaatgtcctgagagtccattcctggagccaagggacccaggcttcctaccgtgtatgtccatttcctgggcaaggcactggatggcaggactttaagcagaggcaggaaagggcaacttccagcctcttgcagaaggcctgattgcgggggcagtcagttgggattgctcagccctgaagcagagactgagaaccccgcctgcctgtgtgaccaccatccatgtccactccctctctgagcttcagtttctccaccggtaaaatgggaagagaatggaccagagagtatttttctcccattcccaaattacagagtttttttttttttttttaagacaggtcttgctgtatcacccaggctggagtgcagtggtgtgatcatagctcactgcagccttgacctcctggactcaggtgatcctcctgccttagcctccctagtaactgggactataggcacaggccaccatgcctggctaattttgtatttttattttttggtagtaacagagtctccctgtgttgtgcaggctggtctcaaactcctggcctcaagcgatcctcctgcctgccctcaagcgatcctcctgccttgggattacaggtgtgagctgccatgtccagtccacagacaacatgtattgagtgctcactacatgccaagcactgggctaagcctgttgcatgtagcatcttgtttacatttcacaataatcaagggggcaggcatctgcctgctttacagatgaggaaaccaaggccctcagcagtaaagtaaattttccaagttcactcagcatgggaatgatagacacaggtttgtaatccaggtcttgttgacatcgaaacctgggatgctagtaaccctaccctgctgcctgtcagtcctgccaggctttccaggacggcccccaccctgagccacatccccaggaacactctgccactccctatccccctcctgggctcataccatgaaagccccatgcagagcctgctactctagagggatatatattatctaaatttgataagacaactcaatttcactccgtgtctgttaccggcgataaaaccaggagacttttatgacccagcatcctcagcaagattgtcaggaacttattatacaaggtctaactggatttctctctgcagatggctgggagccatgggctggaacgcaattcggcaacacatttggggaaataaatgcaaaatgcttgttccagagacttagataaggcagcaggcctccaagctccccaagaatcggatctgcttttcctgggccctgaagggcgatttggggaggatttacgctgtcggaggaggagggaatggcgggctctttctcccctcatcccttgactcttcttgccccagggaaggaatgtgagcgcacctgagacttggagttcagcaactgtaattccctgagaggtagcaattcagagtagacctgggggtgggaggacaggatggtgggcagtggtgagaccaaggttatgaggactgtgtgcattgaaagaggggtgcaggatgatcaaaacgatggggaactgggtcttcactagctgctcgggatctgccatagagtcactccttactgccctgagaggcccgcgtccttcccaaacacacctctaggactggtgtggcccccataaactgggttcccaaacagaccccattccttggatgtgagttcacatccagattcagatgacccccgtacataagctcacagatactccaagattttgaggttcactgtgagggcgctccaaattcatggcttacctcaaattctgatctctcgcaggcgtgggctcatagacgggcttgcggtccatctcagctttcacagcatccatgcgatttttgccattggaaggaatggcaacaaccacattcacttttgcacccacctaatagatctgccgaatcttgaggttggagctttacaagagccagccccaaattcagggttcattctctagtgcagacatcccccaaacctctgctcacacacagatctggcataaccccagattcagttagctgcccaagctagactccagccctctagctaccagcagcatctgagagttaccccctcaacaagctcataccaagccttgaggatctggcacctccagtcccaggctccggtccttgtgcagggaagctgctgcaacaccactgatctgggaagtttgaggtctgcccttgcgcacctgccctgtgactctaagctctttctacggggccaggaaggcggcggagacatttttatctgtccctgggctccccgatgcttcaatggactccagtaccagaagccctttttttttttgagtcggagtctcgctctgttgcccaggctggagtgcagcggcacaatcttggcccactgcaacctccgcctccccggttgaagcgatacctcctgcctcatcctcctgggaagctgggattacaggtgcacaccaccacacctggctaatttttctatttttagtagagacagggtttcaccatgttggccagctggtcttgaactcctgacctcaggtgatccacccacctcggcctcccaaagtgctgggattacaggcttgagccactacgcctggcatgggagctttgtctcattctttcagccctcccttacctcttcccatgtagagttccatcccaactaggtcctttgcctccagtttttggagggaaagggtaacatttgccaagcatcctctgttgtaccagggcctggcaagtctgtgctttcattgaactcttaccacaacctttcaggctagatttttataatacccactttgcagatgaggaaatggaggcacaaggaggttaagccacttgcccaagagcacacagcccagaagagtgggagctttgtatctgccaggatgctgccccaggtcttggagcagagcttgggaatgcccttgggatttggagttcggtggcgggggtggggggctgttgcctaggtggcacgctggggagggtatgctgttgctgaatctaagcttgtattatttccacactggcaaaacgaattattttcagtagacaggaggatggggtgggggtatgggagtggaggacattgcggtgagaccaagagcactggctgccagggccagtcacttgggggaaagggcaggggctggcctttgccagaagacagagatggatggtctggatcccaggcttaggttacctaagggcagaccaagactcagctcctgcattgggggtggtggtggtggtgtcagaaatcactggagaagccaggagggggggcctaccccaccttgggtgaaggccaggaagtctgtggggcctctggaatactaatggcctccggcgggtcctgcaggatgcagcaggcaggctggagtctatttgtctctccattctcaacactgcagtttcctggagaggggtgatggggaccagggagtgaggacgaggcttggaccagggtcttcggctgaacaagagccaggctgcagtgggaaacacatgcgtgctggaactgggctctaccacttcctagctgtgtgacctcagacaaatcacttcatctctctgggcctcaggtacgtgtaaacaggtacaatgatgctgacctgagggttggtgaggaaggcgcacagtgcgtgctggctcaggagacggcgctctctgttataaagccgttaccatcctgcacgtaacaggcaggtcctgaaaatcacctccaaggggggtagagcccgaaaatcccccaaatcctctggctaagagtgattttattttattttttaaaaagaaataaggaatataatcctcaaaagattttcccttttggctctaaaaaaaaatctaatatcttcatttccatccccccctttataagctaatttgttgaaaattaaaatggggaactcaccaaggctggcattttaattgaatcttgtctggtgtcctctctaggattccctggctggcgtcctccattcaatcctccctgctccatttagcccggttcccaaccttggtggggcctcggcgggaccttggtgggaccttggtggggcctgggactggcccctagggcccaagtgactttccatcacgaaaaaggagcttcagcctggcccctgcctactcctaggggtcatggggtcagaggggcccagggcacaatttctgatctgtgcgaggccccctgctggctgcgcctgtttcctcacctggagatgggattcatctgaatgacttcacctaggacccagtactcctggcacagccagcagatcaatacccagtgttttgtcctcactcacctccaagatctggggggctcccaaagcgggggaaagcagggctgcctcgagctgctcctaggcccccacaggagagcttctcttgcatccatccatccatgggtcatccagccgcaggttagaaagccagttagcggcttcccccactttcagggattttggtaataataataatgcttcttttttttttttgagacggagtctcactctgtcacccaggcgggagtgcagtcacatgatgtcggctcactgcaacctctgcctcccgacttcaagcaattcttgtgcctcagcctcccgagtagctggtattgcaggcgtgtgccaccatgcctggctaatttttgtatttttagtagagatggggtttcatcatgttggcctggctggtctcgagctcccgacctcaagtgatctgcctgccccggcctcccaaagtgctgggattataagcgtgagccaccgcccctggccaaacaatgcttcttgagtacttaagtcctgtcagacatgctacctgcagagtcttattttgtgctcataacaacccaaagaggaaggaactatcgttattattatattattgagacagggtctcactgccacccaggcctggagtgcagtggtgcaactgtagctcactgcagccttgaactcctggggtcaaacaatcctcctgcttcagtatcctgagcagctaggactacaggcccatgccaccaagcctgcctaatttttatttttagagacaggggtctcgctatgttgcccaggctggtctcaaactcctggcctcaagacagcctcctgcctaggcctcccaaagccctaggattacaggtgtgaactgtagtgcttggtctggaaggaactattatgatcttcccattttatgggtgaagaaactgaggctcagagaggattagtaactcccaaggccacggagccagatttaatggcagagcccggattagaagtcaggccatctcaccccagaggccccctcaactcagcctcagtttcctgattttggattaaagtgcgtttgccctggccctgggttcctggcgtgtccctgggccctcgccgtactgccctctgcagcctgccttgtccaggaccggcgggcgggccagggactgaggggaagacaggggctctccgtgcctcatcgccctgtcccccaccccgaggcccagcccagaggcgggcttcctcctctgccccgcggggggccgcaataattgctaatcagccaccgctaattatccggcccatggagaggtgagcgcagcaagggagcgcggaggcggcgcagaacccgggttccagcccaggctcgcgcagcgggacgctggcacgacgctcttcatgctcttcgtttctgggccttggtttccctggctacacgtaggggtgggagaaggcagtaagtagggctctaactctgaaatgcaagggaaagagcctcgctgcctaccccaaagaaagctaaggtggttgaccagcttttgattggaggctgagctcagcctggctgcctgctttaaaacctggatgctggggtaacgaggtggtcaactctcacttttctcatccattaaagtactgatatccacttaaaacggttataagggttcaatatggtatttggaatcgttcctgacgtacagtaagtgctcaataaatgaagcttacggctagggagcattatgcttacgttatctcatttaattctcagaacaacttggggagggaggcattatgacagatggggaaactgaggctcagagaggcgaaaccccttgtttcgtgaaccaagcatccattcatccctgcatccatgctgagcatttgctgagcacttaccatgctccaagctcattgctgacacagacagactacctcccgctgccttggggctcaggctccagcaatttgaatttccacccctctggctctccctgagagggacacctccccactcccttgtagtagctggggaggatataaggggaggcccaccccgtggacacccttggggttcgggtgcctaatgatcccccttcccatcaacaactcatgtaaatttctttcgtaattacactgaaagctatcaaactatctaatttaatttctctgcaaaaataaatagctaaagtggccctaggtactggcataaatccttcaggcagaacagtcttagattgctgcttgtgcaggcctgactggccacaatacacacttaataagcacatatttattgggcccgtgcccccctttggaagaagaggcagggattctgttgactcagccagaaggagaggaaagcgattggggccatggtggtaatgtgaggaggagaggagggagcggagggaaaatatgctgggtaattaattatccgtctttgtacatccataactttttatgcaaaacaaatatgcaaatgctgcctaactggttgccgctgcctaactggttgccttcacctgggtctgcctccaacatgagtgttaatgtgcagttgggcctgtggggaggaggcctgtctgcaaagtgggccagggctgggtcagtgtctcctctctccctcacttgctgtggctcccctggtccactgggccccgcatcattactccaatgtgcttacccaaggccagtgggttatgccttcttaatatcactcttcagcagtcccatctctcttcctggatgctatggctcagcatcagatgacatcctttttttctggcttgtttcttcctctccaacctcatttcctgtccttctccctcttgcctggagtgcccccacccaggctcgctgcacctcaggccctttgcactggctttatctctggaatgctgtgtttgcagggtcagctctttcttttcattcaagtttaaggtcaatgttgccttccccaaccacccagttgaaagtgccccttttggttttttgctaccttgttttgctgttttttttttcaatagtacctattactctgataattttccttttttatgtattagtttttcaaatttctttttctctcccgctggaatgtaacttccgagagaacagccttgtgttatttattgctgtatccccagtgactagaacaatatgcatagttggtccttgcaaaatgtgcattacctgaatgaatgaataaagggaagaagagcttcctcactcccatttttgttccccagtcactctcttctatttatgccattcaagataatcttaaaaacacgaatcctactgtggacaaccttccctgactccttagttctttggaataatatccaagttccttttcctgcccctttatgacctggcctctgttcacctctccagcactctctctatccacctcagttcccttcatcctacacacacattggccttcacacgaagcaccaggcttccagccctgcacaaattgttctggttgccaaattctctttcatacccttctttgcttggtcaactccaccttgtcttttgtgtctcagtcaggcattacctcctccaggaagccctcctgtgtaacctcctttttgcctttctccgttgtgacactttccactttgccttcttacctttctgttaccttttgtagatggagagcttcaggaaggcaggaatggtatctagtttctcatcatttaggcaacaattgcagaactggaatatgaaccagattctgaattaagaagataggttctggagccagcctgcctggattcatatgccaactctgctatttaccggccatagtagctgccctctaagatggttcccgatggggttgtggcatctggtattcttgccttagtgcagaccccctcccctagactttgagctggacctagtgacctgcctctaataatacaacatagcaaaagtaataggatgtcacttctgagattaggttataaaaagattgtggcttctttccatcttgcgcaccctctcttgcttgctgtcttgagggcagccagctgctatgttgtgaactgccccatggagaggcccacgtggcaaggaggtgatatctccagctctacaggcaccggctaaactccacatgggttcctggcctgcagaaactgtgagataacaaatgttttattgttcgtttgtttgtttgtttgttttgagatggagtctcgctcaggtggagtgcagtggtgtgatctctgctcactgcaacctctgcctcccgggtttaagcgattctcctgcctcagcctcctaagcagctgggattacaggcgtgtgccaccacgtacggctaatttttgtatttttagtagagacagcttttcaccctgttggtcagcctggtctcaaactcctgacctcgtgatctgcccacctcgggcttacaaagtgctgggattacaggtgtgagccaccgcgcctggccagcagtggataattaaatactgagtaatcatggggaagttactagatctttctgtgtgtcagtttctgtatctataaaatggggataggctgggcgcggtggctcacgcctgtaatcccagcactttgggaggctgagaaaggcggatcacttgaggtcaggagtttgagaccagcctggtcaacatagtgacccccgtgtctacaaaaaaatataaaaaattagcctggtgtaatagcgcatgcctgtagtcccagtgactcgggaggttgaggcaggagaattgcttgaacctgggaggtagaggttgcagtgagccgagatcatgccactacactccagcctgggcaacagagtgagactctttgtctcaaaaataaaataaaataaaataaataaaatggggataatgattgtacccaccttgtgggcttgttttgagggttgaatcagtgtatgtaaagctcttagcatagtgcctggtatacagtaagtgctgtgtaggtgtagctcttatattctcaggacctaggaggtgcttaataagtgttgagcagaaataaacatgatcagatagtagttactgtttactcctccctcgacatgaaggtcccgcttctccagatggcattcaaggcccattatgactccctgacctcggccagtttcatggctgtggtgctggacactgttcagcccgccatatctcatttcattcttatcatagagctaccctatgaggttggaactgtttcacaaacgtagagacctggcttcagagaggttaagtaacttgctcaaggtcacacagtgagaacaaggttaagctaagatttgaatccaggaatgtctagcttctggttcagcttatttgcacgtcctcagtgcctcccaagggcctggcataagtaggaagtgggtacatggccactgaatgaccaactgcttgccctgggtgaatattagtccccccatctcccgcatttgtcagggaaaaaaacaacaaaaaagctcacccctgccgagagattttggagagcaatgcttaacccagaggaccgacccgccaatgggggcctggggcatatgcccaggggccctgctcagtggcctgctttaatgcagggggaggaagaggcagtgggagccagcagggagagctgcccattagccctaattagcagcccgtttggaaaagagcttgggcagaaattaagatgctgtcagtgggtcccagctgggtcgtagcagattggcagctgcaacatttccagagcctgagcttgaaacacccagctgggaaagcctctctgcctgtttccacctggacccagcggcccctgggagacagccagaccctcttccagccagacagtggtcaccaagacacccccaccccctaccatgcgtgcagagcactcacaaagcccccactccttggttgtctctgtggggcctcctacactcctgcaagatggaacttctatacctgttttgcagaagaagaaacagaggtcatgagagctttactgctgtgcccaagacccacagttaggaaatggcagagtttcgggggaacccttggcccagtgccctaagcccaaggcttggggatgggaagaggaggccccagaaggatcctgactagggctgggataggcggttagcaggaggacaggggaaagtgcctaggccccaagtcaccatcattgactccatccccttaccccaacccaggggagggaagagtgccaccagtgccacctcttctgcgggaagaaacaagttatgccatagaggtgggccgggtggagggggaaatagaagtggaagaacaggaaaaccaaacgtcaggaaggacccagcctgcctcccaaatcttcacttcctctcttaaagtgctaagaataaactaggatttaaaatcaagctaaaaataaaaaaaaatcacaaaaccctaaagctgccttccaagaaaccaaaggcagtgattcgggcagcagacatgctgtgggaaagccttgctggacggcaggcagggctgtgcagtgggaggtgggccaagggggccagggtccaagggggcccgcttcgggctgtcagtgttgttattcataataacaacaggtcaggtgtcctgggtttatgacacaccagctacttgctgggtgctttgtagagattaactctttaatccttgcaattaacctcctaggggtgggtccatatcagttcttgtttcatagttgaagaaataggtgcagggggtgaaagggcctgtgcacgtggaggagagagatttccactacaaatctgtccatctccagaaggttgtgtgtgtctcagctacaccagactgagatggggggatgctgccagctatgagggagtccatcatttttacctcaaagtatgacttagatcttttactttgaataagttttgaaagcagagcagagagagaacaggcagatattgactgcctgggaggcagcgaggaagaatcacttcctggaggggagactggggtctcataggagaccaacgcctgactcatcacagatctggttttggtggaaatttaccccaaccttgggccatctttcatccccctagaccttgaccaggggttgacattgacaaagtcccacctatgggctgcaccttgcctattttgccaataaagttttattggaacacagcacatccacatccacttttacttcttgtctgtggctgctttcatgctatggtgacagatgcatagttaccagagactgtgtggctctcaaagctggaaaatactcactctcttgccctttgcagaaaaagtttgctgatccagatcctagatgacataatcatccctttaagatttcagaatcctagaacatcagagccaaagcattcacacagaatatactgtccagctggggcacagggaggggaagggacttgcccaaggacacacagcaaatagtgaaagaaccaagcagagagtcttcagctcttgcattggactgatgcagtggccaggcgggcgaccttgaggaaaccctgacagcatcaatgctagtgctgacaagtgtgtggtttgcacgtccctgacaatccctacatggcattaaataacactgaactgtcacctagtgagaaatgtggttcctcctcagtcctctttcagtctttcgattatgtcaaagggaaagttgggtttggggatcgcatgtctttatcacttctctaatactcagtaatcttcctctgtaataaagagagtatagacccagactgaagccttctgcaggcaatgttatcagacccggcatcagtagccctgtttagtgtgcttatttttacatcaccgtctatgttctgtgttactgtttttccacttaatgtactgatggaagttttgctttcaaaataaaactaagcttaaaaaggaggttgttgggggaagaaaaacattaagtaaataatagttcaggttgtacttggatagagcagaaatcatgaatatggtatttgaatggctgagacagggaaaacaccgatcgattccataatgtttccagaactgcagttccaaggttccgtgatttaagagcagaacttggtctcagagcaagggtagggctgccaacccggtggtgcaggctgcccactgcacaaagcctccaggccctcatctggatgacgagtgacttctaattcacatgaagatgtgctatgggctagcaggctctccagccaggtgccctcatctctgccttctgacttgaggtacagatcccatgggatggggacatcttggaggcagccaggtgattggcagaggtcagagaatagaggtcactgagataggggtgctccctgttgccatctggtcaccctgcctgcagtgaggctgctcctatcccaagctgctgcatgacaatgctgaccttggtggcatgggctgtgaacagccttccataggaccaggccctgcagacagatcaacctggattagagggctgcctctgccacatgctcactgtgtgaccttaggcagcttgtctcccacctctctgagcctcagtttccacaactgtgcaacagagctccttagtgattggacctgacccccagggttgtcctgaggatgtgcattcagtggcacagggaatgagtgacacacggtgagggctgaataaacggcaggtaggctgagcattccccatcctgagagggaccctctggaagtgtcacggggtggtcagctctcccagaggtcacggctgggtctgcatgaagctggtggctgcagagaggccaggctgactcccgcagccactgccaggctgagttgatggcaactggctctccagctgccaggcagctcttgacatttttataggcagatcacaggtaatgagctttccctccagaacctagggacattctggaaaattgtgttcggattgaagtgggatgcgagtggggagagcaggtccaggaggtgagagactctccttgcctctgcctgcctccattcctaccctcatccccactgcaaaggggagaatcgaccaaaaccatctagccacatgggggcccagacccctagggatggtgcgggaggcagatttctcttcccttttggcattcctttgtgctgagctctgtggtctcagaggcagattccctggcattacagaggggcagtgactgtgctccaaaggcctcctttcttccttccatgtgtgcatcctgcatcacgtgtgcatccaccattcccccacccgccctcccacacatcaacagatgtttatggagccctctccttggctatgcattgcactgtgtaaggccctgaggacagggtggtagacaggaccaagaagaggtgtccatccttcccaagaacattcactcactcattcatttactcaacagatgtttactgtgcttctgttatgtgccagccaccatggctagtggctatacaatgatgatcaagaaatataaggttcctctactcaggggcatcaggaggatgcccctccagccttcaggatgggcactgatgggtactcctgagaataaaggtgatggagccctaaggctggtgatgagtgcttacggtgcccccaaagtcatcactgatgactttcatcagtgatggtatcctttcagcaatattggtatcctttcagcaatattggtatcctttcaacgatgatagtatcctttcatcaatgatagcatcctttcatcgatgatggtatccttgacgtattagtgttaagtattgatatgcttcaagcacatcagttacagacactgtcactcctagggcatcaaggatgggtgctagtgggtagaaaccttttgcttctgtgggagatcttggttcatcctccacatttggcctttcttcttccactcaaagctcttgcaggcagacagacctatggtggactctgtggcccaagacattatatgatggtggccgtcccacagcctcccccactgaaagggctggcttcccactggaggccaatttattcttttgcctgggcttctctctgcagctagaatgtcattttccacaaaaccctctttcttgtaattactgagaattactcatgaagagagagaggagagagagagtgtgtgtgggtattgattgccaccctgagaagctcaggaatcatttagagtagattaacctaactttcttttgccttttgggaagttggactctgacttatttgaggagattaatcagctcataagaaatctggacagccttcctacctcttctatctctttttggattagctggggccatgtcattttcaccatgccttcgaaatatccttttcctcactctctagcactccgtctacattttcactattattgcccagtccatttagttcagcaggattctctgtagctcctcttttggggaatgggtggaggcgtccctggctgccattagattaccctgatagccttgttgcctggatcttgggtgggcacaacttcagggagggctgggccactacaggcaagtctcctgcatccaagcccggggtctctgcagctgtcacgtaggaagagtccaaccattccattctaaaatgcagtattttccagagtcttttctgcgaggtttgcacattgattctgcagatgctaatcctatccatccagtcttccggacttccaggtgctgctcatccatcccctcctcttcccttgcaggaagctatcccagactaagcactagtcctgcttactgaggcagagaggatgggaaatgagaggagagaaaggaagcctgagaggggaaagggagaagagaaaaggtggtgagtggccccggggaaggagtcagcatttgcctgactctgcgacacattttgtggagtgcaaaaagggcaggttccggagccagacagacttggggttaaatctcagctctactccttcctagcttggtgaccttgggcaagtcactttacctctctgagatttcattgttcacatgggatgataacagttcctagctcacattaccattgccaaatgagatcttgtatgtgacatgctgaaagcaaggcctggcgcttagtgggtgtgccattgacagcaggtggatatcgccaggccccaaacatgggggactcccaatgaatcttctgtaaagacttgatgtatgatacggaacttcatccttgggagcctctactcctcttcctcatccccctgtctccaggtagctgcagaaggagcagccaggatacccgggtctttggcaggtgaggcccagattctcagctcctgggaagctgagaatattgcaggtccttgctgctgcttctctcctcttccaggaaaaagtttgaagtcaaatgggtcccgaggtggaatattttccaaatgtcagtgcagtctgtggtacattacagctaaatgtgatcatctcagtgctgggctctgaatgtcagcgcactggccgtgatggagtgacaaatagcaggttgacaggtggggctgtggccccccccccttcccctgggaaatcagcctggggaactgggccatctctgggttcagcaggtgaggaccatgggcctctgtggggacacggagtgggctttgaggggtcctgtgcgtgtgatgtgtgcatgcatgtgtgcacatgtggcaatgtctctgtgcctgtacacttcctcttcggtgtgcacaaaggctcagacaccctgggagggagttcactaagcacagctggagatctgtgtgtggctgttgtatgtgtgttcttcatctccatctccatcatgttctccgtgagtctacactcattagtagaactgcttgcatggtgtacacacattttcactaactgaccgtgagactgcgtgtacctgtatagatagacaccatctatctcttgcagtcttttctatggcgtacatgtgtgtacatgatcttcctgtgcccatatgtgtagttgtgtgtgtggacaattgtgtatggttctgtgaatagtatttgattgtatgtgtgtgtgtgtgtgtgtgtgtgtgtggttgtctaggtttataaattccatctcaacagcaaaggtggaaggggaaactggagttgggagaaggctctctgcctcattgcccttgtggtggggcattttgatggttgcctgctctgtggggcctgtgattggctgggtgggatggggattaaattgcctccaattaccagagagtaagcagtgagctgtgaggccagggggatggtgcatggatgccaggatctgacaaccacaacgggattaagaagccctgtgtatgcaagcggcctcatgtatctgtgtgaggctgcgtgctcgtgaatgcctgtgactgtgtgttttgcatctttgtgggcgggtgtatttgcccatgagaatgcaaacaagcatgtctgtgttgtgtgtgtgattatgagaacgcagatgtgtccctgtgcatccttctatgtggctgtcattgtgcctgcgtgggtgtgctagcatgcatctgtgtgtctgggaatgtgtgtgagttgtggtctgcgtcaatgcatatctccatgtctgtgagcatgtgtgtctatgtatatgactctgcatgtgtctttgtgtgtgagggttctgctttgagtgtgtgtgtccttgtgtgagacttcacatatatacgtgggtctctggttttctctgagtagtgtgtgtgtgtgtgtgtgtgtgtgtgtgtggttaaatgtgagggtctcagtgaatcagtggttaggagggaagaggtagggagaaaactgttctccatcccatccccatcccagctggtgatcagaattccaaggcctcctccctctgaccacacctgagtacaagcttccacaaaaaatgggaagactccccattagggagcctgatgaggggtctgtgagctggtgctgagcctggaatggggaatgccatgggttgagttgtgtccccctaaaattcatatgttgaattcctgaagtagttgtacatgagaacgtgaccttgtttggaaataggatcgttgcagatgtacatggctaagatgaggttatcctagggtcggataggctgctaatccaatatgacttgtgtccttataaaagggaaaatttgggccaggcacggtggctcacgcctgtaatcccagcactttgggaggccgaggcaggtggatcacctgaggtcaggagtttgagacaagcctagccaatagcgaaaccctgtctctactaaaaacacaaaaattagccaggcgtggtggcaggtacttgtaatcccagctactcgggaggctgaggcagcaggatcgcttgaacctgggaggcggaggttgcagtgagccgaggtcgcgccagtgcactccagcctgggcaacaagagtgaaactccatctcaataaataaataaataaataaataaataaataaaaataaataaaaaggagaaatttggacccagacacagatgtgttgagggaagacgatgttaagagacacagagagaagatggccatttgtaagcctaggagagaggcctggaacagattctttctcaccgccctgctggcacctggatatcagacttccaagcctccaggcctgggagatcatttggtgctgttgtttaagccactcagttgatggtgctttattacagcagccctaggacatgaatccaggggatgtgaagtgctcaagggcttctcctcccactgcccttctgctccctatggacccatttcacagatgtgtgtgttgtgatcagcggtggcctcctcttcgctccgtctgctctgaagcactcctccctagaggcctcagtttagtagcctcctttgggagacctttcagataaccccacccctgtccctctcccagcccttccctgtccccggatctcaccttccttcaagctgtcctggcaaggccaggctttatcaccttctcaaaagtaagtacattttctccccatttttctcttctctctgcatagctctgtgtccttgcatacaggaggtgcccactaaaggtctcagtgaggattcccaggtttccaacctcttcctgggcttgggatgggaaagaggatttgtcctcacccctccttccccctacaccatgccacctcttccatgtcctaacagctgctgtttattttgttcttactgtatgccagggctaagctaggtgctttagtgggggaccacttcctcctctgaacaactctatggggtagctgctattttggcttcattttccaaaggggaaatggaatcacagggaggataaataaatggtctaagatcacaccttaaaattcacaaatgccagatcaggaaggagctttaggaatctgttaggttacccctctcagctgcccctatttcacagctggagaaacggaggtccaagtggctcttctccctccacctgcctctggtgctccacagggctcacccctgactgtcggatcccatcgttttacacactgtccctgtgcctcctactcttgcagcttcagctttcctgaagacaccagtgagtagaaagaccactttagtctccgctcctcctcctgagctccagccctgcatttccacatcttgtgcatgtggcctgcaggcccctcaaactcagcatgtctaaaatcaaactgatctctcctgacctcagaaccaaggcttctcctggattctctggctcattaccagctttgccgcccttgtcactcaaaggctgaagcctttgacctcctctacccaccatccccacacgcggtcaattgccaactcctgctggctctttcttctaaactatttctcagatccactgacccagtttaagcctcaatgtctctctctgagggtcctgtgtcagcctttcatatcagctagaatgaggtttggctgcttgagacaaaagaccaaagtgacagagactttgacaagttggaagtttatttgtctcttatgtgagccaagtctggagatgggagaggttcagggctggtatggtagctctatgaggttgataagaaccaagtccatccatagggtatgacctttgtcctcatggctcaaggtggctgcttgagctccagccatctcagctgtgttcagccagcagaaagaagaaagggacagtaaaaaagaggcaaagggcatgagtcagcagccttttaaagaggtgtcccagaagctgctacatgacaattcttctaaggttgtattggctgggactcagttcatgcacagttcatacacagctgtgaaggaagctggaaaatgtggcccttgtaatagaaggccatgtgcttggttaaaatttggggcttctctgattaaggaagaaagtgagactgtgacctcctcccttcctcactggtctccctctcatttctttcatcctctaatccagcttgggcaagtagccaggataatctttctaaaatgcaaatctatacatagggttgccagatttagcaaataaaaatacaaaattcccagttaaatgtaaattccagataagtaatatataagtaattttgcataagtatgtcctgtgcaatacttagaatactaatactagaaaaattattttttatttatctgaaatttgcatttaactgggcaccctgcaatttatctgtccagcctatccatatacttttcatggttccccactgttgtcagaaaaagacccgagctctctggaaggctttgctgggccctttgcaatctgtcccccaactgacctgtctaggtccttgttccctgaacaagccctgcactgcttccgctgtctccaagccccccgaacctttgcttaagctcttttcctgggagactgtccttctctatctgagaaggcccatgcacccagagggaacatggcccctgtggctctagattcctggggacatggcagggacgagtgattatttgctgaatgaatgaaatgatgggtccagggacacgcgcaaatgagaggcaaggttggagtggctccctcacattatgactccctgtacagtgctctctgcacccaggttggctcatgtgggcccagcactgggatctctgtccctggggccttcattttccacaatcccacgtctgggcatggcacccccccagcacacaaggggttaagccagccttggagttgggagctggagcccatggagtccttcctgacaataaagctaatgaatccctccttgctgttttctcttgcacaataacatttaatcatcatttgcacagcagatgagaagtttgcagcagatgcaattctgcgtgactggcgatttctgcgtgtgggcatcattcttgctgtccccagcacacctgactatctggggttgggcaggctgtgccccagagagggtgtgtgtgcatccacatgatagggatctgactccacacacgtgtgggagatgggctttggaggcacgtgtctatgtgcgtgcttgtctgtggggttgagttaggcacatggggcatgggtatgagtgaactgtgctgggcctgcctaaaggtgcacgtggacagaggtggttaatgcctgaggacacgttgtctggaagttgaggaacctacatggagacaggcagatgcacatataccattgcatgtgtgtgagtgcttggtgcagatctgagcatttgttggaggatggctgtttgtttaggtgcttgtacttgatcgtgtatattatgttcatacacacagacctatgtcctcacatgtacaaatgcatctatgggagcatgcgtttgaatttggagtttgtaatggactgttcctgaggttacatttgctttcctgtgcgtgcatacaaatgggcatatgactgagaatgagagcatggggttgtatgttcatgcacagaagtacatttgagggtatgcacacatatgtgctatgtatttgagtgggagtttctggggacacacatatgttagtgaatgggtatgaatatatgcctgaatgggaaaatatgtttgcttattgaagagtaccagtggacacacatgtacatgcatgtaagagaacttatctatggcaggcatgtgcatgctctgaatacaaacatgagtgcacacatgagagcttgcctcccatgcacgcatagcatgctggcatgtgtccacatttgcagacctgcagggatatgctctgtgtgtatcgctgtgaacatgtctgcattgtgcccacaggtgcgaacatgtctgtgggtacaacctgtgcatgcatcatgtgctggcatgctcatgcacacgctggaacgtgagccgtctcgcctcagagtgagggctgacagggttgcattttccaaaagctcagcgaccagtgacagagctggcctgggagtgcttgctggcaggaggtgagtggagctgctgatttgtgacctgggggtgggctgtgatgacggctggctgatggatgcaggcgcttagacaccctgtatgacagcagccagctctctgagctgcctgaatcaggaggtgggagtttagttcttgacctgtgctgctcaatgctggcttcccacctccctggtgcttgtccacagccacatgaggacacacacacacacaccagagacacagacccaggcttggacagtggctagccagctaggcccctctgtccatcttgctcccagctctgccatcccctgaagtgcctccccttctcaccaacatgcttctctgttctcccagaaacttcactcacaatcagagtcatctaggccctgtgcagagccgtggcgtgtgggagtgtgaaatcatttcaggcctttaaaggcttcatgcccttgggcaaagcatggttcatctgtgagccctgggttcctcatctcatcctcataaaacaggcctaatgaaagcacctgcttaaaattaaacaaggcaaattatgtaaaagcactaaacacagtaaacacagcgtccattctccatgagatttacctatcttagtattaattatgtatggtgctgagaacagggcctggcatgctgcaatgctatataagtgtgctgtcaccgtcatcactactatcatcgtcgttgttattaatatccctggttctgaaatccttggccaattgcacatcaattcttgctcaagaccctgaatactcttttatcccatgataatgatgatgatgatgacaacaaaaggggaatatttttcttttcatcttcctagatgccttgtaagaaggtcaggaatagtaaatgggaggctctttattttctaagctccttgatagagctgggtttgctcatttggagcttggagctggcatggttgtattttctgcctaacacagcatgtggaactcttggggaacctggtgggaatcaatgagacagatgaccaaaggctgtgcgtcccataaaaccctgctctgtgaccccaagtcatcagaaaaactcacaaatgcttggcatgagtagacaccttgtgcaacccagtgaaagggcaggactcactggatttcactctgggatggctcagcacccagtggagacagcaagtgtggatgcaggagctggaagcaaaggggatcgagggatcattaccttttcctccacaccccactctggaactagcagaaatcacggggcgcttgaggacttctacaggctgtggaatgcagtggcgggtagaggaatgagctctcccagagcacagacagggacttttggatacacccaagcatatgtttggggcttcctgtgtgctggacactgtatgtactgctgacggggtaggttctgggggtcagagcacccgggtttaaatctcagcatctccagttatttgtcatttgatcttgcacaagttacttaacctccttgtgcctcagttttctcacctgtaaaacgagggctgcctcattgcgttgttgtgggattaaatgcgttaatttatgtaaaatgctcagtaagtgtcagctgttgctattgcgttttatccttattgcaaccctatgaagtaggtggtctgagcatatgcactttatggataagaaaactgaggcacacagagggtaaataacttgtctgaagtcacacaatggccgggcgtggtgcctcatgcttgtaatcccagcactttgggaggccaaagcgggaggatcacttgagcccaggagtttgagaccagcctcggcagcatagcaagacgccatctctacaaaaaattagctaggtgtgatggtgcatgtctgcagtcccaactacctggggggctgaggtgagaggattggttgagcctggtatattgaggctgcagtgagccatgattgtgccattgcactccagctgggcgacagagcaagaccctggaaagagagaaagaaagaaagaaaaagaaagaaagaaagaaaaggaaagaaagaaagaaagaaggaaggaaggaaagaaagaagagagagagggagggagagaaagaaagagaaagaaagagaaagaaagaaggaaagaaaggaaggaaggagaaagaaaaagaaagagaaagagagagaaagaaagagagaaagaaaaataaagaaagaaagaaaaaagagaaatcatatggtgggtaaatcgtagagccaaaggctcagaaggcaaatctggataaataatgttctttatttctggcaagatctttgactctgtgtgaccttgggtaagtaattctccatgtgtgaggtttagacaggatgttcaagggacctatgacttcatgtccgtgtgtccctctggacatataatctgcctgtgacctccttcttggcagggtcagtatctgctaaggcaaccagtgcatgtggaagggacaggcttggagtcgggggaacctgtgccgcctttgctctgtcccatactagctgggagaccttgaaccagccactttattcccctgagtttcagtttcccctttctacaatggagctggcaaccaacctcagaaatgctgttgggcttctgtatgtgagagctgggcacacggggctgagagaggtggctgcacatctccccacgggtctccaagttaccatgcccatttgtagcatgagctataggaaccatgggttaaaggtcccacataggatgatttgggggttcccaaatatccctccacttgggcttaccatgctaaccccacatccctgccactggccactctcaatggactttagaaggcatattcaagttgagcaagttatcaagctccttaacctggccttcaagttcttttcacaactacctccaaccagccttccctgcctcacctcccaccactcctccaccctgcgatccagcccccagggccaaaaacccttcccgaagctgccacacacttcttaccttctccccacccccagcctttgcagatgctcttctctctgcttggaatactcttgctcgcatggccacctcacatcccatactcattcttcgagacccagttgaagttacttcctctgggaagccctccaggattactcagtctttctttagtgcttccaggatcttattctgttaattctgctacaattcttaccaaacacattatttttggctgcttcagctccctgatccacttccttcctccaacttacgtcttgggctaccggaagggaggaattacctatcatctatgtaacccttggcagtttactactctcttagcctcagtttcctcatctgtgaactggggctgacagtacctaaatgagaaaaaataatgcaggtaaggcactgggacatactagccatctctggatctatcacagtggaccttggcaaatgtggagggaatgaatgagagctccctgggagggtaagaaaaataaggctaataagcatttattgggaactttccacatgtcaggaaggcactgagttcagagcttaacatccactatctcctttaagacttttaataatcctttaaggaagagactatcattatccccattttacagataaggcaactgaggcttcagcagtggaggaccttgatgaaggatgcccagctagcaggagctggaattcatgttggatcaatgtggaatgaatgaatcacttgggcgtggggggaggtgggaggacaaataaccgtatcttataatcatatggttttagagctggaaactcttcaggtgacttagtccaggggttcttaatttgggatccatgagtgggaagactgatgggttccaaagccagacagataaggtccccccatcttgcccagtggtttctgacccctctgtctcctgccaatccttgcatccactcaagtcctggagtcacccagcttgttcttgcttggctccgctggtatttcagtgtggtctgagactcctgaaggctccgcagttgccgggagtgtccttatcccccatgcagggcaggatcaggagccgacaactgcaaccttttcccctcccctgggagatgtagggaaaaggggaagggcatctggagcaagggagagagctcagaccttggaggcagacacactgggcttctaagaaccacaaagataagaatagtaacaaaggctagcatttattgaacacctactatgtgccaggcactgtcctaaccacttgacacatatgaaccctttttagcctcacaactcttcgaggtaggttctgttattaaccccatttgacagatgaggaaactgaggaccagagaagtgaagtgacttgcccgaggccaggcagctggtcagtgccagaggctctgccattcactggccaggtgcccttggacgggtcacagccacttctctggggtcctttccccttctattccgtgcaggacaccacctcatggtttctctgacgactgagctggtctctgtacagcgtcccagcacacagtaggtgcttagtaagtgaacagccttctttcctcttaactctgatgggggaaacctggggtgggggcatctcagcggcgtgctccctccagcattctcccccaggccaggattgagtgacccgccccttcccgactctgcaacgccacccccatctcccattctaaccccagagccacaccgtgcccggtctcgcctcagttttaatgccgttggtcagaatcccgcacctctgggctccaaagctgcacccctagaggaggaggaatggaagagtccgctcctagcaagtcccccctccgtccagccgccaagggagggttgggggagggcaggaaagggggtccgcgggggaaacgcgttgtcctggggccccggcgtgtgctgggcgggtgagcagccgcgccccgacggcagggcgaggggctaggaggcctgggcctcgtcgtccccgcggtggccggcgtagagcgcggccaggggccggaagcgcggaccccagctgctgagataggcgaagtcctgctcggagcccgacgagccgctgtgcagggagctgagcgaggcggccggcgagtccgcgccctcgaaggcgtaggtctggaaggcgtcgtagggcggcaccgacaggtccccgtccgccagtgccaccttgcggctgatgaagtccctgaacactgagaagtctggctcggggctcggcggcccctgcggcagcgagtggcgctcggagggcaggtgggcctgcggggggctgcccgcgcccccgcccgagcccccgcccgctcccccgcccgcgctgccgcccccgtcgccgcccttgagctcgccgaagtcgtagaggctccgcagcgccgacatgtcgtaggcttcggtgtcctgctcgccgccgccttcgtcgttgtatttgatgacgttgtcccgcatgtcttcatcctcgtccgagctcaggtggctcttgtggtggcgcctgagggtgaggatcagcagcaccagcactgcgagggggacagagggggcaactgagggccaagcccctcccagggcattagaaggaccctctaccccatctcctcccgcctcccacccagcagagcgggcccagcctcaacattcctacagatttcctggatttctgttcaaaaagccattcttgcaatcagaactgagctgagtgtctggagaggtagtgagctacccatctcgggaggtatgcaaatcgaggctagattactctggggtggaggtggccaatgggagagcagtgttaaaggttttcctgggtgttgaggcctgaggtctcccttctcagccctatgaagagatacactctctgaggactctaggtgctgggggtctgtagcaggcagctgagaaacagaaggagctggaggagtgaaagatgtccttcaccctgacctctctttcaccctcaccctcctctgccacaccagaagtcttgagctcctactcaatcctttggttctcaggtcaaggcctgcaggaacccttccctgagagctgcaggccaggttccatgccttcccctgcaagattccccaggacggggctccttcctctatcatactggttctcaaagtgcggcccctgggcaacagcaacatcctcctgggagcttgttagaaatgcagacccttggatcctggcacggatcttgtggcagtggaggggaatctgtgttttaacaagacctgcagacctgaagaggcagctcaagtttgaaagccacagctctgtcatagaccagaccctgctgtgttaccaggtctgtctccaccccaaaacacacaccctaagctaggacctgggaaatgttcctctatcttggtgcctggcatgcagtaagcacttgaagcatgcttgttgaatgaatgaatgactaaaggaagagttggatggagacttgggtaagtgaatgaatgcttgtcccctcttggctttcttcacttgatttccaggactccacattctcctcctcctcccacctcactgatcactcattctcaatcttctaagcaggtttctcctcgcctctcttaactcagatgtcctaggattcagacctcggttctgtgtccatgctccctctcttggagctctcctttggtctcaacagctttaaaagttccatttagaaactgacaatccccatatctcagcctccagcctggacctctcccctgaaatctagattgtacattcaatttcctactcaacacgccctcttgttgaccaagcgaatctcaaacttaacaggttcaaaggtgaaatactaatctttcccccttccccaccccgagtctcccccacctcagtgttaggaaccccgacttttcaattactcagggcttctaagtctcttttgttgagtgctaaatctcagtgtctagtacatgggaggaactcactggatggatgtataggtaaatgatgatgggtggatggactgacagatggacagacatgtacgaggtactgtgctgggcactggactcttcttgctcctccaaacagctccagtggccagagctggctgtgagggccatggggcagggcacctgctcaccacctaacaaggtggcttgtgacagggaagagcacgagagctggggacaggcccggagggagggcacagggaaggaaggtgtcaggagagaagtgggaaagatggatggatggcttctggagccgaggctgggagctctggagggggatgcccgcgggagcagatggtgaggtttgcgggtggcgggcgacagatgtgccaggcctgatcagcgattccacccgtcacctttagagcactgatgtgcactttcttcgtttgtgggcaattaggcagaactttgtttgcactgcctcggaaaatgaaaccgctgtaaagtgcaccctctggaaaaagggtttctgagccatgggctagggtggggggagaagggggacctcccaactatgaggagcctgcccagggcctctgctgggacctgaggaggtacagcctggccataggcaggtcctcagagggtggacagaggccgtgccagtgccagccagtgagggcggggggaggcagctgacatctcccagggagcagagcaaggctggaatctgcacttggacctcccttgagctcctctagctttggcctcagtgcccttctttacttgggtggttacagctgtaacaggtggcatatggccattcaaatccaggttagcttctgaaacttgacctcttcattggggagactttggggtgcaaatggctgctagtggcctggtaccagtgtagattttgcccccctcccccaccaccaatgacttgagattttgctctcagtttagattcatagcaggtggtgtagttagaggagcagaggacacagggtgagaagacctaatatcaaatccaaagattatccagtacccttacaccagccacctaacctctctgacccccagcgctttcatctgaaaaatgggatgatatgcctggccatgtgcttgtgaggttcacaagagccctttttactaaaagtcctacatagagactaaaaaaggaccattcacatgagaaaattttttaaaaatatgctagggtgaggtttgggctacacgtgaatggggtgggccacagtgagctcatccctggagttggtggcggggccgctctgcacttagaagactcctcatgggggctgcttgttagagcttggagatggtttggccagcccatcctcatgtggagagggaagctgaggccccatgggggctggttaggaaggaaacccaggacgccaggatggggccaatcaggcagggctgggtggctctcgatggactcaccaaccaggatgagaacgcagaccaagagggcgatgagggcgccggggctgagggaggcggccatgacaaaggccgtggtgttgcaggactggatggtgccggagctgtcgcagccacagatgcggatggtgagcgtgcctgtgctgctcagtgtgggcggcccactgtctaccaccaggatgggcaggaagaacacgtcctgctcctgccggttgaagcccacgtgctgcgtgtgcactgcagcggtgttgtctgttccggaagaagggggagcggtgtgacttggggccgggggtcagcatccttgtcctagccacctcctgattgcatcgtgagatttgcctccctatgccccaaactacagcctcccaatggactcatgggtctcttctctgatctcccaaaattctattaccagatgcctccaaattctgccccatgctgcccaaagattctgtcccccaaagtctaccctcagctgcccaaaatcctgtccccatgtagcccacaattctgtcctcaaaccatcccaagattctgttttcagctattctaagattttgtcctcagctgtgccaaggtccccagctattcccagattccgtccccagctaggccaaggtcctgtccctggcgttgtctttttttttttttttttttttgccatttgtctcaacagcttgtttttgctctagattccaccccagcttcccagcgtattctgaccctaggaatcctatagggtccttgggttgtggtttgttgggccctgacaagtcctgggtcctcagaagggactgggaactctggctggcatctgcctttggctgtgggatctttctgtccttcataccccaaggccagttgagagtcctggagcctgacaaggagtctctgcctaagaggctgagcctagagggctgggggcgtggtgaggggcctgatgaggggccctggagcattgaggccttctccacatctttccttttcacataggcggccagagaggacagtgaacaaacacaaatggaactcatggcactggttcagcctgtcaccggggaagccaggcaggacgcagggggatggtggctggccttggagcacaggctgaggtgacaggtggcacccccttctccgccctttctgcctccttcacacctgttctgtaggagtcaggccacctgaccctctgtcattttgatggcctctctcagttctgcacatgcaggggtacgaagtgcccagagctccgaaggctgctgcccctcccttcacagccaactctgccaaagggggccctgcattcctgctgggggccttcagtcctccttctccccgcggtcttcagtctgctgtttctaatctgagagccagatctgggagatctgttggcagcctgggttccttaccctgcttcgtggccccagttaacccagctccttccccagacgaccccaattcagtgtcccagatctggcctttctcatcatggatgctatgcaggaaaaggagccctacgaaggtctgacttgtggcctttggcacatctcagaagtggactgcaggtccagatgcagcacgactggctgtgagttggaggctgcccacgaggtgccgggaacatgagggttcattccattagcctatctccttttacacacatttgagaatttccattaaaatgttgaaaaataatgcaagtctatcatttactagctggggaaacccactgagcttctctaagcttcagtttacccatctgtaaactcagaaagggtatcatgcaggtgtgaggattaaatggtgtaattcacacataacccttagaaaagttcccagcccatagaaatgctcaataatgctgattaatattttttcagaccccgcccccatcttccctgtgctgcacccgctgccggctccctgtctaggccgccctgcctttcctcataaagttcctgctctctggaacaccctcttcaccttcttgcctgggcaaattcctcatccgtcatgctccagctaaatgtcacctcctttcttgtggcctcctttctccgcttccctgggaaggaaggatttatggctccccgctccctgctctgactacgcaggtgccatgcacagttctgttacagcacttgtcacgttgtgttaagttagtgtgtgcctgtttctccactgcatggccagccagggctggcatggagccagtcttgaagagcaatccttgaatgaaccacagcttttgggagaactggtggtcttgggtcagcccctcaggtcactgctgccaccctgtccccggagcttacatggggtggtcacactggatggcagctctggtggccacctcagccaaacagaagcaattaaggcagaatctcaggccccttgggttggaaagccttgtgaacttggcaaggttgagtcaagttcgacagttcaaactggctacattcaggcttgaactctagctctccccccaaaggatgcgtcaaccccagctgggaaaaatctgccttctgcaggggaagaaagggggctggagggcaagatgggagaaagagggaatggcatgggacccatttgtactgaatggattttttttatgcatcaaggactctctgcatattttaaatacatagtaatgtttaatcctcataacctgttaagagttgtggcattattcccattttgtatatatggaaattgtggctcagagacaagtgacttgtctgaatttttccagtgaaagcattcttccttccttccaaccatccaacaaatctttttttttcttgagacaaggtctcactctgtcacccaggctggagtgcagtggtgtgacctcagctcactgtgacctcggtctcccaggctcaagcaatcctcccaccttagcttcctgagtacctaggactacaggtatgcaccaccatgctcagctaattttttttaatttttaaagtttgttttgtgtgtgtgtgtgtgtgtgtgtgtgtgtgtgtgtgtgtacagatgaggtctcattgtattgtctaggctggtctcgaactcctggggctcctcctgcctcagcctcccaaagtggtggcattacaggcataagccaccatgactggcctccatccaacaaatctttattaactactatgtgctaggcaccatgctagtcgccatgagaaaacaatagagagctacaccagctcgctgctggtcctggatcagagctcatattttcatgtaagaaacaatgctaatcaaataaacccacaatttagtctacaattacaaaccatggtgagtgctgtgaaggaagaatataggaagagcacataacagagcacctgagccagtctaggaggtcggggagagcttcttggaagaagtgatatgattcctgagcctgaacagtgagtttagggagagggaacagcgtatgcaaaggtcctgaggttggaagaagcataacacactcagggacccgggacactcagaggacactcagtcctttgtggctggaggaatgagggtaatagctacaatgagtcaagacgaggctggaggaggaggcaggcggtcattgtggaaagcctgggaggctgtggtaaggaatttgggtcattttcccttccttcccttccttcccttccttccttccctccctccctccctcccttccttccttcttcctccctccctcctttctctcttttctttttcctttcctttccctctttcttttcttttcttttctttctttttttccttccttccttccttccttccttccttccttccttctttctttctttctttctttctttctttctttctttcttttctctctctttctctttcctttctttcttcctttcttcctttcacagaatcttgctctgtcacccaaattggagtgcagtggtgcaatcttggctcactacaacctccgtctcctgggttcaagcaattctcctgcctcagcctcctaaggagctgggattacaggcgtctgccaccacgcctggctaatttttgtactttttagtagagacggggtttcatgatgttggccaggctggtctcaaactcctggcctcaactgatgtgcctgcctcagcctcccaaagtgccatgattacaggcatgagccaccactactggccagaatttggataattttcttaaaagcaacaggaggccattgattggtgggctttaagcaaagaagtgacctagtgacaaacccattcattcaacagcaagtaggaattgagcatcatctctctgtcaggactattctagccccgggggatactgcaatggacagaatggatgcggtccctgtccttgctgggcctgtgttctagttgaggcagcttatcatctaaaatgcaggagtcgatgtggaagaacagccaggaagctctcgtgtgttttaggtgtgagataatagtagtagtggaggcacagagaagtaggcagatttgagaaatgagcggctggctccggctcagcttcagattgccaagcaagaagagggatgtttgtctctcagggttgctgtcttgggccatgggaccatatgttctgggaactctggtccccaccactcctccaccccatgaaggggaatccccaggcatcaaccctgaatgcatcaagctgccctcctgggcagcagctggcttcagttggggaagcctctggccaccccggtcccctaccccacccttctaggtgggatctgtgcccagcgctgcatccatccatctggcctgacatacatcagtgtcaatccctggctgcaaaggcaatatttataaatcacgtttccaaactggctacacatttgtacaaagaaacagatgggttggggtagccgtttgtcacctaggatatttatacagtgaggaggagggggcttggcaagtagtgggaaggggctgagggactggaggaggaggaggccttccacggctgctgtgacctcagcgtgctgctgccaccctgtccccggagcttacaccaggtggcactctggatggcagctctggtgcccccccctctcccccagctaaacaaaagcaactgaggcagaatctcgggccccttgggttggaaagcctggtgaacttggcagagttgagccaaggctagctgtgtttcctgtgacctgctcaggatactactggactaatgaataggcagggctgtactggttgttaaaatattgaaatacttccaaaaaaggcttaaatagctgttgacactaagccccccaaatctctccctgctgcctcagccttttccccaggcagcctcccaactttgacacaatcaagccacgaaggagttaatgcctggtgtagtaaagtttccagggtcctgctccaggttttggtcagcgtcctttctgattggccatctgagctgcactggttgttaaatctgtttattatttttcattatttatttttaattattgattgactgagacaaggtctcactctgtcttccaggctggagtgcagtggtgcgatcgtggctcaatggagcctcaaactcctaggctcaagtgattctcctgcctcagcttcctgagtagctgggactacaggtgtgcgccaccatgcccagctaattattattattatttttaaagagatgggttttcactgtgttgtccaggctattctcaaactccttgcctcaagggatcctcctgccttgtgctggagttataaacatgagccttacatatttttaacaggactcccaggggtacagatgggtctggcttcagaggccactaaggctccgcattgggtgtgagtgtgtaaaggccttgagaaggatcccagacctgttccaaggccagaaggaacccacatgatctggccccctcgctgaccacatctcctcccagtcctgtctcttactcactctaatcacacaggtctcctccattcctaatccaccccagtcctgctcaccacagggcctttgcacttgctatttcttccactggggtggtcgttttctctcatatcctttaggtcccttctcactatggatacccttggagagtccttcccaggccaccctatttaagaagatagcttctcctcttaccctgctttctctctctctttttttttttttagatggagtttcgctcttgttgcccgggctggagggcaatggtgagatctcacctcactgcaacctccgcctcctgggttcaagcaattctcctgcctcagcctctggagtagctgggattacaggcatgcgccaccctgctggactaatttttgtatttttagtagagactgagtttcaccatgttggccaggctggtctcgaacttctgacctcaactaatccgcccacttcagcctcccaaagtgttgagattacagggctgagccactgtgccctgctttatttttcactgtttcattgaacacattttatcaaacacctacgatatgccaagcactgctccaggcacctagggttgaacaaagtcaagtccagacccttgtggagattgcattattcctccaccccagccacttatcatccccaacatacttttttatttgtgtcatttctgtctcacctcactagaatataaactaggttttgttgtgtttgctgttgcatttccaggacccggagcagaccccgacacagaggctttgtgtctcaataaacactcactaaataattgctggatgtaggaattgacatttctaggtattaacactatatcttggtggcccttatcttactggggctacctagccacccgaggcagtaggtgttactcccattttagatgatgaaactgaggcttagagaggaacaggcgccccagcactttggtaggccgaggcgggcagatcacctgaggtcaggagttcgagaccagcctggccaacatggcgaaacctcgtctctactaaaaatacaaaaattagcctggcgtggtggtgcgtgcctgtaaccccagctactctgaaggctgaggcaagagaatctcttgaccctgggaggcagaggttgcagtgagctgagatcgcaccactgcactccagcctgggcaacagaatgagatgctgtctcaaacaaacaaacaaacaaaaaacaacaaaaaaaccccacacgcatacacacacacacacacacacacacacacacacaaacaacaacaaacacaaaaaaaccagagaggaacaggagcttgccagggtggtatagagcacccttcgctgagcctggtcccttatttccagtctggtgactgcccccttccctcagtctattccttaaaggttcaaacatcaacatcatgagaaacttgtgagagccagaggggaggaatctcacagtggactcaggcagggcagggcagtttgctttccaggtggtgtgctgaggcaggaagcacactggacttgggatggggttgggttgaatcctacccacaccactgactccctatatgaccctgggcaggactctttctctcttagagtctcagtttcatcacctgtaaaatggggagaggagtcagaaaactacctcacaggatggctgtgaggttgcagaaagaaatgtgagtgggcctggcgtggtgtctcatgcctataatctcagctctttgggaggccgaggtaggaggattgtttgagcccaggagctcgataccagcctgggcaacacagcaagaccccatttctacaaaaaataaaacaattagccagatctgatggtgtgcatctgtagtgccagctactcaggaggctgacgcaggactgcttgagcctaggagatcaaggctgtagtgagctatgattgcaccactgcactgctgcctgggtgacagagcaagaccttgtttcaagaacaattccaaaaaccaaaaaaggaatgtgagtggaataaagcagtttttaaactgcagggtgggctgggcacagtggctcatgcctataatcccagcactttgggaggccgaggcaggccgatagcttgagcctgggagttcaagactagtctgggcaatacggcaaaaatcccgtctctacaaaaaatacgaaaagtagctgggcatggtggcacacatctatgctccgagctacttgggaggctgaggtaggaggattgcttgtgtctgggaggtggaggttgcaacgagccactgcactccagcctggctgacagagcgagaccctgtctcaaaaaaaaaaaaaaaaaaatcaaataaaaagccagaaacctgcagggtggggagtgtgtgcacgtggcttacttcagtctccactcagaacgggggctctttccaccctggactctggcacaatcattcctcatttattccctgtctatatcttcccatctgccatttcttatccttgggacgccctcctccactccaccaacccacaccctgcttgtgtttggccagtgggctgggtaacagctccagcttggcccagactttccatgtgatcttagatccaacataggccctgtgggcgcctccgtccctctgtctataatatgggaacagggcagggagactgtgcccctcccttcttgcatcctagggtttggaggctcaccttggatgtcaagcagagagaaatgagggttgctgggagcttcaggcaccaggcggaaatagaagcggtgcccgccttggggctcgtctctgtccaccacgctgatggtctggatgagctgaagggtgaggaggggatagagggctagtggtgaggctgagaccactctgggtcgaggtagaggatgctgctggccagtcctggaagcaacgcccagtccccaccccctcaggggtacctggcctggcttggcatcctcgcatacagctgcctcgtagggtgtggccagttctgggggattgtcgttcacatccaggattcggatccttagggatgcccgggatagctgtgcatgattgtctgtaatgagagcacaggagcaaggggagaggcatcaagtgggagatctagatagcctcctctctactatgaggacaatagtaggcagtggggtcatgctgagaaatttgtgggttaaccaagctggtacaaggaccagaactgggaacatttgggcataagttaagtaatcatcactgtaatcaccaccaccattaccatcaaccttggcaccattggcattatcactacaacgcttgccaccacaatcaccagtagcacccactgccatcaccaacaccatcaccactgtcagcatcaacaccaccatcaccatcccatctccaccatggccacctttgccatcactaccactattactattaccactgtcatcattaagccattaccaataccactatttgcattatcatcagtgcgtctatcaacataactatgagtaccaccatcaccatccttatactgttaccatcaccactgccatcaccaccatcaccatcaggtcatcaccatcactaccatcaccattagaattagcaccaccaccaccagaaccacatcctctagtactacacccatcatctctaccataaataatactaaagccatcaccatcactaccctcaccaccaccaccaaccccatcaccatcaccaatatcaccatcaccaataccaccaccatctcttccatagtcaccacaaccacaatcaccagcccacctattactactattacccccatcataatcaccaatattaccatcacatccctggcccccaacaacactgtcatcaccactgccatccccaccccctcaccacagagcacacagcatgcacgtggagcatctacattcattattttaagtatccttgcagaaatcctgtggtttggtacaatttctatccccatattgcaaaggagaaactaaaacgtgggatgctttctagacatgggtcggggcaactaaactccaagacttctgctttctcaagacctgatcctaaaagggccagacaagtccaaggaggtagatcttcgccagcaaaaccatgatgtccccacctctccaagttgggacgtctttaagatcatggtccctgtcttatttatctctgggctaccagcattgtgggatatggtacatgtaaattctaatatattaatatttgctgaatgaatgaatgaagcctggaaaaattgagactgcaggaggcttgaattccaggcgtggctgtgtccctgacccagtgtttggtcttgggtaagaccctgccttctctgatgtcagtttccacacctggaaaatgaacagagcatagtgattatgagcagtgctgggtagttctgattccagctctgctgttttatgtctgtataatccaagccaggtcatttgacctccctgtgcctcaattttctcacctgcaaaatcggtctaatattgacccaattatgcctagcgttccattattggaacgctaagcatgtgagagttatttatatcctactgctcaaggacttcgccaaggtctgattgcaaaaattcaaaaaattgcaacctcaggcataaatgggttaataggtcggtgaagagacagattgagttaatatctgcagggcatttgaaactgtgtgtacaacacgtagcaagtgctatataagcatttgtaaataaccagacattctcgaagggtcctattagcaataacattaaataattctaggatgtggaatacttcatcccagcctgtcctctctaagcagtgccctgaatgttggtgctttctaacccctcaccagcccagacctctgagtgctcactggtgctccatcctctgctatcttggctacatgttcattactgacatgttccacctgccagtgacctcaggaacatctcctggaggaggaaaccacacctcacttccaagcagtgacttagaagatggggctctctggctgggctggcagggagctctctgaggggcagcctgaaagcttccaggcatccaggctccccaagagtttcacggggagtgggactggtcggctgcctcctgctgtaaactcaggatccactgtgtgctgacggcagctgctcacgtgttgataaagagagaaacagagataggaaggcaggtgcagccacctcctgggggggcgggcggcggtcaggaaaaggagggggctgagttcttaattaattcagaccccagcttctctctggagttccccttagccaggggcacattatcttctaagctcaccagatctgccactccagtgattagagggggcttttccagggcgagagatgggagtcgtgactgggaatgccgggtgaaccgttatttttaagagtgcgttgccggagaatttcaacagacagacggtcggtgcttttgggaagaggggggtgaggcccacagccaggaacaggcgcctctttcccagcagaggcagagggagagtagagggggcggccagggcctgagtgcccttacagggccctttcccctgcagtggagggtggtgggggtgtgtgggctggagggagagacagggtcctatgggccatgtcgaaggtacagcaggatggactgctgagtgagtgatccgctcctggatgctcactgcagatgagacccccattatagcacctttgctttgggctatgctcggcctctcttacctcttcttttaaaatgtcacaggtcaccttgtgagaaagccctaatgtccttggcatgagtgagagtctcagacctaagaggtggggcagctgagtgacccctaaattgccatctgcatatcttattctaggaattcctgaatttagggctggcatggaatcccagagctcattggctggccccaggtcagtacccattgccactgccattgcccttgtggcagtgggtctccagcacagctgtacatcacaatcacctggagagcctttaaaaacaccgatgcccaaagcttggtcagtgattttttttttttttttaaacagctccagaggatcagcctgtagcaaggtttgcaaaccactatgctagggtgactgggaggcggggggaatccagcctgattggcttcctccaaacccctcctatcacaattagtatcatttataagaatggaaaataatcgtattttgccaccttaaatgtttctgggataaaacaaggaatccatctgttgattaatcttgatctctgtgcaggattttccaattcataacactctctcttattatgacctcgtgtcatccttgaaataacccttgaagaaggccttgttaaacccactttctggatgaggaaactgaggcccacggaggggcaggagtttccccacagccctagcggagtcagcagcagagctggggttgggtccgaaccctcctgactccaagttcagcgcttggtcctgatacaatgtcaggggccctcctgctgcctggtcatttgtccattcagtggcagctatggcttagacccaggcccaagtggatctcacccaatggccggctgcaggtgccccctccaaggactgggtgccccacagccctcccctcttggcttttcagttcagctgactgacatgcaaattagtttaattatttcttcttctaaaataaattatattttgcagtagctgcaatatgttgtgtcaggcaaaattacattcaatatttttaaactaattgatgcagccttgaggaaggctgattgacagcccggggctgagcaggcctgcagccttaaccgattcctaaattaaaattaaacgtgctttggcccggtgcttcctccttgaactgcctcaccattaatccgggggggtggcaggtgaagccccgggggtctgagggacctgaggaggctgggcagctcagggtgcctagggtagagaccaaactcggggcaggagaactgctgtgcagtggggcaggtctctcaccttcactgggcctcagagtttcttctgtataatggacaggggattggactggacaatctggaactgaaacctgtggtttttgctgacagttgtggatcaagcatctcctttgtaccaaggactcagcagtgaacaagacagcatggtctcgttctagtggcaggtacagacattactccagactgtgataagagctgagggaaaaaagttaaggagctgtgagagcttggagcagggggtcttgcctggtgggatgcaggatgtttttcctggaaaaacatgatatttctgctgagtcctgctgagtcctgactgggaagtaattgtatgagggggatgggaaaggaaagactgtctcaggcagtgggatcagcacgtgcaaaggccctggggtgggaggggaggatgtggataatgagactctggatctcttccaaggaggatcccagcccctactagagttactcatttgacatctggaccaacctgagtgggcgtggggatggggatgggggccaatgggaaggcaagaggagacggggcctggcctggtgcccctgttagggcgctcctatgaatgtgctcctccctggaagaatggcaacaaacacacattaagtacatgccaaggaccagggtctgggctgccccatttcgtcctgtcaaccacggtgggaggcagggagtgctgttgttgctgttttactgatgaggaaacgggctcagaggggtgagaaaacttgcccaaagtctcataggagctgggactcgaacctgggtctggttttaaaggggagtttttaaccaccacatgatgttgcctttcttgtctttagctgtcagaatccatcttgccttcaaggccctgaacaaatttccctgcttcctccaggaagctttccttgattgctctcagttctgggcaatccaaggataagcccaagtcccccatgcccacaaggccccccatgatcatcctgctgtggtctctctggcctcgttgctacccctccctccttctttcactctgctccaagtttgctcctttacctccttcaggtcttggcccagatttcttctaggagaggcctcccctaaagaccttatttccatgtgccctttgccatcctaccaaatgccacttccctgccttattcctctttgtagcatttacccagcaccctctgtttttatttaactttctcatcctctatctcctcccctagtatgtaagcagaatttttgtatattttctttactgctgtatccccagcaactgtgtgcacactacatagtagatgcttaataaagatgtgtcaaatgaatggattccactgtctgtggcatttctgaccatggccacgctccaggagggatgctggggaggtgcagggggagaaactgagaccttcttggatgaactgactctgttgtatcagggattgggtcccctccatttcagaaacagtctagtgctgggaccctcttcctgcctctctctttctctgtctcttgaccaaggttttctcatcagtaaaacaaatggagttggattctgtggctctccttggctgtcacagagaaagacagaagcctggagagaaagagagaagtgaagctgcaagagtgggagtgggaaggagagtggggggtggagtgggagggggagagagagagaggagagaggtcagctcaaagaaagtgccttccctctcacttgcagtggcagggatagagcagagcttggaccctcttctccactatccccccagcccctccctcctccccgagggagttaaattgcatccaaacaccaggctctgattagagctggccagctgggcaggaagatttatcatcccaattacaagcccgccaagacaagcaggcaggacagtgaggcgcacgggacgagcagatgggggtgctccagggaagggggtgtcagggtagacagaagcgaactccttgcactccctgccctgtccccatgcccccccccagtgggagcaggaggctcaggtgcccttctctgtcccttgaagggacttcagtgatctatttggtttccacatggagactggaagctttgaccttattggggggacgtttattcctccaaggaaggggtgggggaggacttctgggtgaagcagggaccctgaaatcataacatccctgaaattcaaaggggagatgtgggaactttccttccccagtggctgagctggtccctaatgttctgggctgtcctactccatgtatatcacaaaatctttgttccccttggggtccgttagggactcaaggtggcacaggatcccaggagtcatccagtccaagaggaccctgggcctgatttgcacacctctggtgacagggagctcactgtctcttgaagcagccccttccatgcagagctgtgacatgtctctttcccgggcagcctccctggagctcccaaccacctgccctggtcctgccctggaccctccagcccaaagctgagcctgacagcctcccatatgttcccccgactccatgtttgccccctccaagccatcctccccatgaacccgagggaacactggggaccaaacatctgatcacgccactcttctgctcaaagacctgtgctggctccctgtcacctccaggagatgtctggttcctcatgggacaccaaggccctttctgtacaggcccagtgagcttcttcactcaccccttgcctcacctgctctggacacccttcagctccagagcctggccacacccagcctctctgttctcagaatggcctcagacatccaagctcccaggcctttgcacacagggggctttctgctgggaacacctgaatcccctttctgcctggaacacctgaatcccctttctgcccatggaaaaacttccttggcctttgaaacccaactcagatgtcctcttggccaggtgctggtgctcatgcctgtaatcccagtgctttgggaggccaaggtgggaggattgcttgagcccaggagttggacacaagcctgggtaacagagtgagagccccctctttaccaaaaacaaacaaacaaacaaaaaccacacacacaaaaacaaaaaaatagatgtcccctcctctgggaagggttttctggccctcgctgggtaggccagtctctccctgctcctcaggaatcgccgcgaccccatgactttcactgtgtgttgtcactgactgtcaatgggtctctccccgcccacccgtgaactctcaggtcagtggccaagcctcgttcatcactgggtctcagagcccagccctggctggggtgggtgacaagaggccccagaaaacactggctgcgggtacatggcttgttggtgtgtgtgtgggtccctgcaggagaaactgagcactctctgctgctcagaccccactgtgaccttcactcctcatccctgtccctttctccagcctccttaggcctcctctatggtccttctgagaggcatagactgggagtcagaaagcctcatgggggaactcccttccttggcgtctgtctccccaggttgggtatggggctggaggatgggtatagggctggagcccatcatctctgacattccctctcctctcagattctctccctgactattaagagcacctactgtgtgtcaggcacacagtaggcacctgcgctaggcacttgaggcacattatttctaatccttgggggatttatgttttatagaaagcactcagcacaatgcctggcatattgtaagctttaagtaaatagaagctgctattattattaattattttttgagatggagtctcggtctgtctcccaggctggagtgcagtggtgcaatctcggcccactgcaacctccacctcctgggttcaagcaattctcctgcctcagcctcccaagtagttggaattacaggtgcccaccaccacacccggctaattttcgtacttttagtagagatggggtttcaccatgttggccaggctgctcttgaactcctgacctcaggtgatccgcctgcctcggcctcccaaagtgctaggattacaggcgtgaaccaccgtgcccagccaggagctgctattattaatagttaccattgtcacagctatctggtaaactaagtatgattgtcaccattttgtagatgacaaaaccaaggtaacaagatgggagtgacctgtccaggcccacccaactgggaaccatgcgactagaagcatttcttctccatcatgcattcctgtttttccaactgggcatgcaagcccattcattcatccattcggtaaacacacatgcctactgtgtgcctggcctgtgtgtgctgcaggtatagactgggccctgccctcatggaaggtacagtttcccagggaagagcgatcttcactgaatactcacacagacccatctaaaaatcataacacgtgctctgtggcatgaagggaaaagcagggtgctgtgagacgtgacttggcctggggtgacccagatggggaagcttctggcgagtctggttaaccctttgctgtcctggacatctagctattacccctccagatcagcttagggctggatgactcttgagagtgtggctgggtgccccccttggcactcccgcctcccagtgttggttttccaagtctcccctagaccccccccccacccagtctctttgaagactgtccctttacaactgccctttccaccgaaggattcagacacaaattgtactttaaattcaatatcagtcattaatatttcatgattacaaaacgttaaagataatgtcagtggaaggagcgtctgcatgggcagaatggatgactcagaagttcggggagaggggagccggcatactaagtggctcgggagtctttgaggtaatccagtatgacaggcggtggctcctggctgagtgcaacattctccgaggtgctcaccaagcgccgccgctgtgtataaatatttcccctctgattcttgtcacctcatgtttattatgaccaggagcaggtggggccaccatgaccctctgagtttcccttctgtttttgaggaagccaaatggacgctttggcaggagggcatggggctgggtgggcagacccgatggccatgcacctggggctctggctggctcctgggaagccggaggtcttgggtcaagcctgcccctgccaggacttgctctgtgatcttggggccatccctgttcttccctgagcctctgtttcctcatctgtaaaatggggataataagtttgttcccatctcatggagatggtgaaaaggaagagtgggtcagttatttgtggcagctttttttttttgagacagagtcttgcctgttgcccaggctggagcgcaggggcatgatcttggctcattgcaacctctgcctttgggttcaagcgattctcgtgccttagcctccccagcagctgggagtatatgcacacgccaccatgcccagttaatttttgtatttttagtagacatggggtttcgccatgttggccaggctggtctcgaactcttgaactcaagtgatctgacccctttggcctcccaaagtactgggattacaggcgtgagccactgtgcctggcctgtgagagctcttgattttgtgccagcaccagggaaacaggactggaggggcagctgaggagagccgggctctggagtcaggcaggctggggttgggaacctggacaaatgacttcgccttgctgagtcaggttcctcatccccacagtgaagatggcagtagaatggacaccccttaggggtgaagatttcatgagctcatcacaagaaagggcccggaacagagtcaagacctacagataccatcaactgagcacttactaagcaccaaccactaggctaagttcttcccatgagctatgctgtttgatcctcccaccagctctctgaagcaaaaccattccttttcccattaattaatatcctgggtgaggagtgggcaggggctggggatcacagctcagagaaggggggtctcgagcccagtggctagtcttctcctttcagagatacatctccttccccacagtcagttactggggttgatggatgggatgggggtggggctcagacagcagagagtgcccagaaaagggaggccatgcagcaatgccgtggggaccaagcatgcctggtccaaatcccagctttgccagtgcacatctttggcaagcaagtttccaaactctccaagcctcaattttcccatcaggaaaatgggtgctaatcatgctactgatgataattcaataaagtatgtgctggaaagcatctaggccaggatatatatatatatatatatatacatatgaagcaaaaattgtaaaatgtttgtggaggagtacccctcccccgattctgtctcctatgaaatggcagccttacaggcttcatatgctattctagctgctttctgaaagagacccactgggtagaagcacaatgcttaacccaagaggagattgttgctggtggtgggacactgggccggtgataggctggtggcggaggggcgtgtatctgtgagtagggagaggaggcatccctgcccagcagccaggccagtcctccctcactccatctacagcccagagcctcagttgctacccagggaacaggtttgaggaggcaaggagggggagctctcttcccccaagtccagccaccacttcctctccagccacctttgttatctccctttcatgcggtagaggagtggattcaaaggctccagagcagcagtcactgaggtctgagccagctttgtatttccttttaaactgcagttgaaagagacgaagggaacttcagcctagggacttccttgaccccagaatgggccagtggggcctgggaaatggggggatggcagctaggggaggaggaagagggctggcaggaggagcttgggtcaggaggggcctggggcagaggggcctgggatcctgatgggcagaggcgagtttgaatgttgcctacccgcctgcagctcagagactcaaccatattcctgttgtcatgattgcttattggtggctctgttgatgcctgagaccttgagggctgatggggtagagaagctgggaaagcaggtggaggccatgacagtggcagtgttgctctgggcatggaggaagcccaagggcactccccctggcctctctcccagtgctctcagctcctcacctccacagccttacttacctggatgccatgtctcaggctctctctctttctctcccagctcacatttctccctagctgcaccaaaaagacacacacacacacacacacacacacacacacacacacacacacatattcttccagaaactcaggccaaacaccctggagtcatccttgacccttctccatctctccccgggacatcagcccatgagcagattccactggctctatcttcagcctgtatcccaaagccagccacttctcacctcctcctcccctcctctgtagctactgccctgggccaggccatggtcctatctcccaagcactattgctttcagcttctagctaaggccccgtttccctctcaggctccaggctcttctcaatgcagctgccagaggtaccctgatggagaacatccctcctctccccaaatgcctccaatgactctaacttcatttggagtaaagtccaaagactctccagtggctctggctgaccacgctgcccctcatcaaccacactggcctctttgctgttcctccaacgtgcttggcaaattacaccgcagggcctctttgcactggctgttccccctgcttggaatgctcttcctgcagatgtcagcatgactccctccccttttgaggtctttgttgaaatgtcttttcctcatctcttagatgttcccctaagagaagcaacgcacctcctcctcccagttccctttcccagcctccttctctccttgtttcttcttagcacttagcatcacctgacatattatgtccgtgctttctctctgttgatagtcttgttctccctatgaggacagaagcttttctgtcatgttcaaggctggatccccaacccctaaaacagggcttgcacgtagcagatgctcaattaatgatgagagaagaaagcctagtttgagaccagccctacccccttgacttggaaccagccctactcccttgacttgcaaccctgctggatctttgctcgcacccatcagcttttgccctcgccttcaccgctgtgagatctttgtctagtttctttctcttcgcaccatccccaacctttggcccctcccccgtgggctttgactgacagggctgccttggccctgcccccagcccttggcccctcccttcagcttttgctcctgggccccatatttgcccttggagggggcgtggcgcccagctcacccgcctccatggccagcactgtgatgttgtgccagccggccgtctcgcggtccagccccttgccagtcacgatggcgcctgtgtccgcatcgatatcgaagatctggtccaaatctgattcgcggtcaatggcgtacctgcggggggcagggcagggctgattgaaggtgccccagtgccaaatggagcccatgtccttttctcccaaccccactccaagagagggaccgcctgccttggacacacacaaggggcagagaaaccccttgcgaccgaggaggagcgggaagcaactgggtgtgcatttcacttgcacgggtagctgctgtgaccatgggcagccctcaacctttctgagcctcagtttcctcagttggaatggagctaataatttgtacctgcagttgtcgtgagggttggaagctggcaaaatgcttggcacagttagactcactgatactctcttctttcttttcttttcttttcttctttctttctttctctctctttccttccttccttctttttcttttttgtttatttattttattttatttacttattttttggagatggagtctcgcactttcgcccaggctggagtgcaatggcaccatcttggctcactgcaagctccgcctcccgggttcacgccattctcctgcctcagtctcccgagtagctgggactacaggtgcccgccaccacgcccggctaattttttgtatttttcagtagagacggggtttcaccgtgttagccaggatggtcttgatctcctgacctcgtgatctgcccgccttggcctcccaaagtgcctgggattacaggcgtgagcgaccgcgcccggccctcttttctttctttctttagccagggtctcactctgttaccctgggtagagtgcaatggtgccatcacggctcactgcagcctccatctcctgggctcaagccatcctcctgactcactgagcctcccgagtagctgggactgcaggtgcgtgccaccacgcccagctaattttttttttttttttttcagagacagggtttcgctatgttgcccacactggtctcgaactactgagctcaagcgatccgctcgccttggcctcccaaagtgttgaggttacaggcatgaaccactgcaccctgccgattcttatctttccctaagaggtgcccctggaactgagcttgaaggcagagaccgggagtgtgggtggcgttctgggcaggggaaacagaaggtgcaaaggcgcggcggctgagaattatcccagaaatggcaaacactgcaaaatggttcgaaccgggaagtggggagaattcggcaccagaacacaccggcacagcacagttggcgtgtactggggagccaacggggaattttgagcaggggagaggggggcagttgtggcattaggaggcttctctgggggccgcggcgtggacacgcccagggacacgcgctgggcgagtgccgtgggagggggcctggggacacggccgccggctcctcccgcctgcgcagcacgcgcgagctaatctgcagcttttccgttgccgcgtgaaaaagccctttgttccgccttcttcccgggcctttgtgtggcggctccaggccttaaaggcccgtgtccaacacatgtctcgggcggcggcggcccagagaggcctcgccagctccggcctccgcttccccatgctgataacgctggtgggggcgccgcgaggctgcgcgcggacaaaggcctcgaatgccaagcaagcgctcattgtgcgccaggacaaagcagcctggtaaggaggggcccctgcgcagccacccggcccctcccacaggcaggaggaaaggggcctttttgtagtctcccagagtggggaggggaggaccccagaagcattgcctgctggggcccagagccctgagatgacccgtctgtgaggccttggctgcattgccaaacctctctgggcctcaactcccccatctctgaaatggggatattgacacccactgggacttcgtgggtctgaaagcagtcagagctgggtttgaatcctctgccactgattctacctgtgtgaccttgggcaagtcactccttggcttctgtttgctcacctgaaaaagaggatgactcctactcaccccacattgtggtgttagaggaggggcgggcatacaggacagtccttatgcttttcatgtttactgtcctggaggtgaatgcctatggcaaactataaagggatgtgcctatgggtgtagtgggcattataagccgatcccctgaacccccagtttaatgctccatactgttcctaaactgctaaacccatattcttcttgcccctggccaccttgagtcccgctagcctgggcgaaagtacgtggggaggttcagacccacgattataattcctccctagcatgcacctaacagtttggagcctgcttctcccccaaccatccctccattcattcctttatgccctaaacactaattgagtgccttctctgtgctggtctgtgctagactctggggataaagtggcaagtgagatagaagaggtctcggtcaggcatcttatgaggctgatgtgatctcccccattttacagatgaagacactgaggtccagagaggaaacttgccaagcttagagctgccaagtatggttgtgcaggttgtgtcatgcacaaagataccaggccgaagtggggaagcaggggtgaattccagcgagccttctgcttgcccagccacgtgtcctagaccaggaagtatcaaaggggggcctgtttcttatttatacaaaggtgacaatgagctagtgatgccgatgccctgctcaagggtgtacagcgactctgtcacagaactgaaatttgaaaccaaattggggattctctcccagagtttaattttttttttttttttgagacggagtcttgctctgtcacccaggctggagtgcagtggtgcgatctcggctcactgcaagctccgcctcctgggttcatgccattctcctgcctcagactcctgagtagctgggactacaggcgcccgccaccacgcccggctaattttttgtatttttagtagagacggggtttcaccttgttagccaggatggtctcaatctcctgaccttgtgatccgcccgcctcggcctcccaaagtgctgggattacaggtgtgagccaccatgcccggccgccagagttctttttagcctgaccgacagcccatccaaagttgaaccagccaaatcctcgatgcatgaagcttcagggtcccctttgccccagcctggccccatcagatatctgagtccaaaggaggttgaaggaggctcttgagcatcatcagctcagctggaaagaactttggagacctcctcccattctacaggttggaggatagaggccaggagaggaccagagacatgacatagcctgggcttctgatccctcgtcagggctgggcgagaggccgggctgatgggaggatgccaactgccttcttgttgtttctcctcccttcttggctcagagctgtctcctctctcctccctccatgctgctgctgctcctcctcctcctcttcctccttctcctttgccctgtttttctcttttgttctttcctcgaggggaagggaggggctggaatctaaatggaggcagctgttcctaaggccatagggcgggggcagcggggacccgccattaactagctaaagacctggggctgggggtcagtttggctggctgagcccaggtgtttttattccagctcagggagccagagagtgagtgggagggagggaagcagggaggggtgggaggaagcagtgtgtggcagggactgtggcctggcaaacttaggggtggaggggtggggtgggggcgaagcttgtgcagctcacgtgtagtgctcgcatgggttgtgtatttggtctgtgttgtgggtggacagtgtgtgttttgtgtggcgtgaatatgtgagtggtgttcctgtgtgtgtgagattgtgcattatagttgagcagtggctcaagaggcagcagctcagccctgggtctggatccaggtctgcattgcccccaggcaagtcacttccatctttaattcccagcaaaatagagatgataatcctactttgtaagttgtcgggagaatgaaacgcatgtaaggtgcctagctgagttccaggaaaattactccatgaatgggaactattgtcactgtaattattattcagagatgtctggcagggagtacacaggagtccccccaacccagtgtgtggcttgcatgcctgggggcggggaggtaagatgtagggacacagtagtctgagaaggacaggaggaagctgtgggtctagaaggttctgcttaaattttgcagtcctacttctcatttggtgacaacaacctgaagggcagcaaggggaactagaacaggtgaggctgggggaatagggagagaatatgagtttgtggcagctcgtgtgtgtgtgcacccacacatgcaagggaggcctgggaatggtgcttaggggtgcagatctgatgcccatctgcctaggtttgaaacctagatgtgtgaccttgggcaagtcacctaatctctctgttcttcagtttccttctcttaaaaatggagatagtaggccgggcagggtggctcacacctataatcccagcactttgggaggctgaggcgggaggatcacgaggtcaggagtttgagaccagcctggccaacgtggtgaaactccgtctctactaaaaatacaaaaaattagctgggtgtggtggcatgtgcctgtaatcccagctactcatgaggctgaggcaggagaattgcatgaacccgggaggcagagattgcagtgagccaagatcgcgccattgcactctggctggggagatagtgtgagactctgtctcaaaaaaaaaaaaaaaaaaaaaaaaagagagagagacagagatagtaatacctacctcacaggctggttgtgaggttcggacaagtgactaccaagaaatccttaagatggttcttggtgtacagactagctcttacttttctttgttgagcaagactttgtatcatgagctcttcgaatcctcagatactgtcatcactctcattttacagaggaggaaactgaggctcggagaagccaggtatcttgccctgggtcacacagggctagttagtggcagagccaagctcccatgtctgttcagagccggaggtctaacagcatcctcttaaggagccagccaggtacacctgctagcatttctgtgttagcaacagcacaaaatgctgctgttgtcaaggttagggtggagaaaatggggagggtgctgcttcctggctggggtgcacgtgtggttttcctctacataaatatgtgcatatataatgcatgcaggcataataaatagggaaggctgcaggcttatgcacatacaggctttctggtgtgcctgtgtgtgagtgcatgaacatacgagcagctgactgaatgatgcagctgccgcccaagctgctcgtgtgtgtgtgtcggggtgtagttcgggagcctcttccaaaacaaagcagcctgcctcctgctccactgtcccaaccaagggattcctttctgctcactccaccctatctgtgactcttttcccccactccctttaggcatatacagaaaagcccacacatgatgcctggaaaattgtatgtggttaacactagttgcagaatgaaagggaaaaaatgggtgtgcagaccaccaagaaaaatggtaatgaccatttctcgagggcctgctatatgctaagcacttaatccttcttccaaccctgagagcaccaggcacagaacttggtatgtggtagacatttaatacctatgaatgaggcacatactattatgatgtctattttagagatggggaaaccgaggctcagagggggtgcattgacttgcccaagactccacaactgagctgggatttgaacccaggtctcctctgatttcaaagcccttgcagtttctgctgcaccacactgtggagtgctgggtggagaaaggaagtgttcgcttcctctgctgcagtgtggactagctgtttttgatgatcaaaggagactcacaatggggctaggtaggaacgtggctgggctgataaatggccagtctatctgcaaacctgcctaactgagaggtgggcccatctgagcactttcctgcctccttctcaagccttctaaggcttcccactgcctagaggataaagtcccacttcttcatgtggcattcaatgtccttcgcagcctgtctccaagtgctcccttgtcccttgtcgtgagcttgtccagctggtctcgctgctcctgaacttaacctcctggctccatgattctgtccctgccatctctcctccccatcactccaacctggggcacactctccccattccaagccttgtcctcttcgtccccttgcaggggccttttggggcaaacctctgtcactccccttcctggtgcataaactactcacccctccctggagctcctcaagcccctgcctcagcccaagcccacttggacctggacctgtcactggattcgttcacacgggccaagctttcccactggcccatgtctgaggccatcatctctgtggccagtgcacaggggaggacgctgcaccagtttaggaactgcactaaccacaaggagagtaagaagcaggagtgaaatggccaaaggctggattcaggaagtggtgagtcatgggtcaaaccccggtgcttccccttttgagctgggtggctttgggaagtcatttcccctctctgactctcagtttcttcgtctgtcaaatgagtacaataccctctgaagggtaaatgtagtaacatgaggcaccttctactatctccagtgcagatgctaagaaaaaatctctctgtactgtctgctttcctataatttccaggcactcactgtgccctgcaaaccatgctaggcaaagtctcccaggatgccacctcatgtcttcatttccagggacacgccaagcttgttcctgcctcagggccattctgcttgctgttccctctacctggaatgcttttcctcacatttttgcatggatggctccccatcattctgatctcagctcatgtgtcacatccctgaccactcaattcaaagtggccctctgtggccccaatccctccttatcctatcactctattttcttcatagtgctttcagcagttattccatttaaccatttgctgtctgtctctctgcaggagaaggcaaactccacgtgggcagggatcctgttttatcatctctgcttcctcactgcacagaacagtgccgggcacaactcaatgcggagttgctgcctaagcctgtgaccctgagaacgcaggtgctgccagaatggaacccttagagcgagctggactctggcagcacacatggcctgtgaggaccccttctctgtctcccacagaccctcaatggcctcccatttccatttttgtaccccacagtctgggagctccaccccagttctgtccttggctgagtcatcttggtgtccccaggcctggctcagggcctggcatggaggaggagctgggtaaatgtttgtggtgttaaattggaccagtctccagctcctcactgcctccacatctgaggagccccagggaaggggccggcaaagagagatgaaagaaggtgagaagcaggtttcaaagttggccctttcagtgcagataaaagcaggagggaagggagccaaagcggggaggaggaagaggactgagagggggtgtggagagtggaattggagaggaggggagctggcagatgggaggactgacctggggccaaggactcgcctcccgctccgtgttcttacctccctgggagagcctgcagaatcctcctcccctccctgggcctcaactcccagacaaacagaggtgacagtgcccttcctggagaggtctgggcccaggccagaggccaagggggttgttcagagactatgccaccagcccgggtggaagggagtggaggagttcagaggcagtgacaggatggcattggcagcgagtgtagtgaaagtagcgtgggcattctcggcttcaggacagagtctgagctcctcagcctgcctctgaggccctgttagacttcacttttgtgcctcatctttcccggccccctgtagcgatcacagtctgctcttcttcaggcacaccaaccactcctctgcctgtatacctctgcacaagctgttcgtctgtctggaatgtgcctctcctgatatttacaccatacccagatacctaggtcaggtcaattcctgcctccttcagaagtcttcccagactcctggggctatctcccagtctgagaatccatgaacagttaagcaggatagcatctgtgtgtctcacttagggctgccatgtaaggttgaacaggctgtgcactgcacaatcctgatagagccattcagacagacaatgacggaacgttgccctctggagttgcacaatgcagaggtcctcaaataaactttccctccccctctcctcaatgcccagcacagggctaggctcatagtcagctcaggggttactcattgaataggtacaggggttttgggaatgaatcagggagccccagtgcctccttcccatccctctaacactggccatccccccagcccctaacctcctcctctggatcagtttcttctacagcctttcttccctcttctatctgaacatcttccagcctaggctactgtcagagactccccaatacttacagctcccagacccttccagggaccccagctgccccatccctgctctgcctctggcttgcctgtgtctgtgtctatttcttcccttttctggtttcctctccaaggtgcccttctgtttccacattgccaggtcagtccctcctgtcctctttttatgggcttttctttctctccagtctcttcctctcattgttggtctctctacatctctgtgagtctgtttttctgcctcttttttcagtctttatttttattttttagtttattttaattaattaattaatttatttattttgagacagttttgctctcgttgcccaggctagagtgcaatggtgcaatctcggctcactgcaacccctgcctccgggttcaagcgattctcctgcctcagcctccagagtagctgtgactacaggtgtgcgctaccacacccggctaattttgtatttttagtagagacggggtttcaccatgttggtcaggctggtctcaaactcctgacctcgggtgatctgcccgcctcggcctcccaaagtgctgggattacaggcatgagccaccacacccggcctctatttttacatatcattaattcaccacatattcagcacgtgtccactgagtgctgaggcctgggctaggccctatgggtatagtggtgaacaaatagacgtaaatccctaccctcagacagcttacctttcagtaggagagacaaaaaaggtaatcagaaaagcaggtagcatgtcagatggtgatgaaaggtaataaggaagcagcagaggaagacaggggataggaagagtcagggctaagggttggggtggagttgaaattttaggaagagtggccagagaaggtctcactgagaagatgacttttgagcaaagacctggaggaagtgagagagcgaactatgggggctattagggcgagaacgttctaggccgagggatccgctgtagcacaggcccagagtgcagatgagcgtggtgtgtttgcaaggctgtgagggggccagtgtggttgcagcagagtggactggaaaggagagggaggtgtggtctgagaggttcagggaggccagagctgtcattgtaagggcttgggcttttattctgagcctagtaggtgtctttggagggcttgggcagagcagggccaggctctagttcacatttgagcaggatcaggctggctcctgcaacaattctaggttaaagaggggtgaggacagaatcagggacaccagcaaggaggcaactgcaatactccaggcaagagaaaacggtggtcgggaccaaggtggtagcagcagaggtggtgagaagtggtcagattctggatccatttttaaggtagagacagcagaattcgctaatggattgaagggaggcatgagagaatgagaggaggcaaggatgcctccaacgtttttaacctaaacaactggaaggatagagctgtcattcccaagatggagataacggcaggcaaactggtgggttttttttttcttttgatggagagaccaggaacccagttctgaacttaagtttgaggtgtctagcggaacaccaagggagatgatgagagggaagggggtgcagggagaagactgggggagtcctgggcacagggatggcccagtcgagagatcagggagccagtgtggctgcagccagcagcgcggagaccccgccagtgcagtgcccgcctctgtgtctgtccctcctggttctctcccttattggcctggctcgcctgcctgtctcattgactgttctcacatctgcttccttggctctttggctccgtgcctgtttctctccacccgtgcgcctctctccgcgcctccctcccccacgcagccccttccttcggccctgcccgccccagccctcctcccctctgcccgcagtctgtccgcgggggtgatggcgggatagcaggcagcaggcgtcggccccgggcgggggtctcaccggacgggccggttggcggcgtcggggtcccgcgccgtcaccacgccgaccagggagcccacctgcgcgtcctcctgcacctccaggaggccggagggcggccggaactcggggggctcgtccacgtcggtcacggccacgcgcacgatcgcctggtcgcggaacgtgcccaggtcggcgaagcgggggtccacgaacttgttgagggcctccaggatcacggtgtgcacgggctgggattcgaagtccaggcgctgcgggagggagcagagggccggttagtgggtggggtctggtggacactgaggccttcacgagggaggccaaggcaggcggggttggcccaaggtcacacgttgtctcagcaggggcggcagggatgtttgggctgcattgcagaactgacccagaccaacccggtgggttacgggtggagaaactgaggatcctcgaggacagtcttgcctaaggacacagccactccaggctaacgcgctgagcacccaaacttcctgcttcccagcgcagtgttggcggcatatttcattagtttagttcacgaacacaaagcacctactgtgtgccagtgctttaagtatattaactcaacttgacatcaaccctaagaggcttgtattcttatgatctgatcttacacatgaggaaaacgaggcccagaaaggctcagtaacttgcccaagtcaccgggcagtgagtgagtccctagcagagccaggattccctggtatgcaggagttagcaactaatgtgagttgagcccgataagccgggctgccttagagctttcctctgagatctggctaaatccatgctgagcctgtgcttcttatcggggggtgctaatgggtgaccctctgatgaatgagctccatggctgtgtgttagctctgaccgtctaaagacactgcctatagcaacgaaaaagccatgtcgtggagctgcagggacctcagctacatggtgggggagcgatctgattggcaagagtgaccttccaggagactcacaggcaggtgcctaccctgtgtatggggtccccccattgctctcagaatcccccacccccgacttctccagcagcaaaaacagccgtgtcctgcctccagcctgttgcctgggaaatcaggatgcagggaggcaggcggtggcctggcctaggagtgagtggtggactctggagccaggccatcagtctgctccctgagccatcaccgactccgcagagacaccctaggcgccactgctggagtgggcggcaggagggggcctgagagctgggggtgggggagattaagcagcccaggggatgagagcaaatgctgtgctggagtccccgggctgagtttgaagcctgattctgctgctctgtgaagctgggtttctctgggcctccaattctccatctgtaaaatgggctcatctaacagttaaggatgaacggagatcaaaagactgaaaatcactagtgcttaaaaaagggagattctagagctggaccccctgagcccgtatccctactgaacgatactagatgcatggccttgggaaagttaccgaacttcttggggcctcagtttctcatctataaaatgaacgattacagcatctcagagggttgatgaagggatcaaatgagttaatacgcagaaagtagttgaagggtgcctggcatgtggcaagcactttatcacaagtagtagctattatattattatcctctggaaaggagctgaaggaactgggcattttgtctatcctcaagccctcaatgccaggtaaagagcgggtcattatgtgcttgctgagcaaaagaaggactgttgagggcagatgttggaaggcagagctcaggctgataggcacagatttaaggagacagatgccggctgaatgggaggaagaagagctggacagtggcagaaagtgagcattctgtcgctggagatatacaaacaaaggcctatgaccacttgtgggccagtgcaggggacttagacctcccatgggagagtggggtcggagtgggtggtcttaatggcctttgcagccctgagttgccaagcccctgaccaaatcctggaagatggatttttgcctctttatttgacctccctagggatcgctgagtttgcagtttgagtttctggttcctgggccagccagtgggcaaggaaggctgttagactcaggaaggaaagagctttggagtcactagacctgggttcaaatctctaccatgtgccttacaggtgtgaccttgggtaagcccctttacctctctcagcatctattttctcagttataaaaatgaggatagtaacctcagcttcagagggaaatatgaggattaaaggcaatgaggagtgtgaagaggctggcaaggatgtgaagcacacgtcagagtgtttgagggtgtggattcccatctggattgaaccctggctctgagaaccagctgtgcaacctcagacaggtcacttcacctctctatgcctggtttgcaaaaggggaatgataccatcagtgtttttccaggttggtcctggacctctagagagaactaatccattgagtggagtgaggtgggggtattcggctgcccagaggcctccctgatcctcccacccctgaggcctgcctcccccattcctcctgaggcagctgcaccttctgcactacgatgatggcctcctgagtgtcgctgtctgtggtgaccttgaacacatcgccgccgctgctgctctcgtccttaaggtggtaagtcatgtctgtgttctctcccacgtctgagtcctcagccttcacacgtcccacagccgttccaatgggggctgactcctggatgctgaactggtacatctctgtgggggacacggccatgagcagggatgaaggcagccccttccccagcctctgccagcagtgggggaggggacaagggggcccaggtgagcctctatggaggacagtgcctgaaaggggctctcagcttggccagaatgggggctgggagaggaatgtcccctgcagaagtttgggtggcagtgcaaaaggagggtttaaattctgacctttgggtttattcactggttgatttggtaaaatgcctgcagttctttgggcctcagtttccctacctagccagtgacagggacagaggagcacagtgataaaggctaagactccggagtcagtcctagctgtgtaaccctgagcctcagtttcctcctctgtaaaatggaaataaataacgatggtgccttcctaacagctgtgtgtttatggcaactaacttagatgatgacgcctgtaacatgcttagtacagtgcctggcacttggtagctactcaagaaatagaataaattgtgttaaaatggtggggcttcatagtgattttgctgttgatgttaacggtagttattccttcatttcaatgtatacattgagcacctatgatgcccccagacatcatgcggttctagacactgcggttacagcaacaaataaaatggaccaaaatctcagctctcatgttgctttcctcttaatagaaagggaaagacactaaacaatcacatcagtgaaacatatggtatgtccaatggtgataggtacttaggagagagataaagcagggaaggtgtgggagtgctgatgagggtgttgcgcagttttaaataggctgatctagaaaggccttgcagagaagatgacatttctgcaaaagtcagaaggtggggagggagcgagccaagcagatatttgggaaagagtattctagacagagggagcagcaggtgcaaaggccctgaggtgggtgctgtgcctggcatgttggaagaatggcaagatggctgtgtggctggaggggaggagcagaggggaaaccagaaggaatgagatcagatgggatggaggctgcagcttgctctccaaccagagctgaggtcgaggtgaggatgacttgctaagtgatgggccagcctagctgaagcagggtctgtggggatgtgtctcttgggggctccacaggtcttggtaacccttgcgtggagtggctgcctctgattcatcctcatacagcagccggggtggggcactttctgaaacacgagatgaacatgccactcccctgctttaatcccttttatagctccccattgcccttgggatggagttgtgcaagtcccttggcctgccctacaaaacactgcctggccccttctggcttctccagcctcatcctccaatccccactccatctctagcttcagccttgctgaagttcttgtgattctgcaactgactcactctctctcacctccaggcatcccctctccctgtcctcctctctgcctttgccttcccaattcccgctctgccttctagtctcactgaatgttacctcctccagggaaccttcccagacctccaggctctgctcctgtgctcccttggcccccaagcttatcccattgttagaattactgcgtttttactctcattttctgtttattctctctcttgggtatgagctgctggaagaaagggaccacatctcttattcatcaggcattcccagtgcctggcagaatgccaggctgtcgcataaatgaaatgtgtgagggactagtgagtgtatgaatgaaaaccagcatgagttaccagtagacactcaccagattaacacaaatcaaagaacgtgacagtaccaggagtcagtgaggatgtggtacaatggacatgtgcgtttcctcatgggggaaaacagtttggctttatttggtaaagctaaagatgagtacatcccatgacccagcaatttcactcctctgtatccatagagaacaagtgcaaatgggcacctggagacctggggcaataaggttcaaagcagtctccttcccaatggccccaaactggaaataatgccagtgtccaccacccccagaatagataattatggaatactatacagcaaagaaaatgaataaattacagctaccagcaacataagttcataaacacaattttgagaggtaaaaagcaagacaaaaacaatttgtattgtatgattcatcccatttatataaggttcaaaaatggatgaaattagacttgtgactggtgatgcctgcgtagatgaacagactcaaaagatgaccatcacaaaagcaggtagtggctaactggagggaggagttggggaagaggctatgatcaggaaagggcatattagggcttctggggtcctggctggtggtcataggattgtttgctttataattatttgttgaactgttgtttttgtgtgccatagttcatgataagaaagacggaaagaaaaagaaaggaaggaggaaaggaatgacgagcaggaaagcaaaccttctgggggccctggcctcctctctgctctgccccaccccttccagttcagagctcattcagagcctggcacaagtgggcagaagactgggtgggggtgcgtcccacccatgccacccgtctgcatggggctgccttcaggggctggggctgggctgggagattgggcagtgggatggcttctgtgccaggctccctggcaccgggaagccggttggtgagctcagctcactccgctctgtgtctgagctgaggctgtaggccacaatgatgctgcgctctcagctaagggattggattcccttatctctcgggggtcagtcccctgtggcggggcctaatgtgagagcagcagacctcaagtaatgactcacccgataggaatcagcccagctcctgcggcatttagtccctgccagctttggtggcttccctgtagtggctctcggcctgagcctgggacagaggggttggctgggctgatagggagctgggaggctgggccggagacatcccccaacccccgctgtgccagcagaggcagagggtggaaaggcctcctaattcagaagcacagagtcgcgctacccaggctcagaggaggagggaaatgcctgtcactcagacttagtttttctctgcacaacctctatctgtctgggggctgagctgcctctgcctagatccctgggtgccccctttctccccagtaccttccctctgcaagcctaggtcagcggcatgggatggcccaacaagtggctaggggagtgggcaggggccagtgaggggttggaggatggacggaagggtggatgggtggggctccccctctgccggaagcaagaggaggtctgggaaggtgatggtgtgttacttggctctgtggagcatcggacagccctggggtcttccttggtaggaagcatggttggaggggggctgggggatagctggtggcttgggaggacagacagacagacagaaagagagggggaagcccttcttttggtgggaagtctaaagggaagctggggtcagcaggtggcttggatggggtaacagacagacacacagacgcgccttcctctgggaaggcctcactcactctgcgggaaacggggcgggttgtcattgacgtcggtgactacgatggtgacggtagtggagcccgagaggccacccagctgacccgccatgtctgtggcctggatcaccacctcgtagcgctcctggctctcgcggtcaaggtcaggcacagccgtccggattacgcctgtgggtgagtgagggtgaggccagggcaccccacaccacctgcccactgatgtggagacccctgtacaggcgggattcagaccctgtgactcctgggaaaattaagctcaggaggagagtgggccacacaaggacatccacgtgtccaccatgtgggacagggctcagtgtacaccacacacactcacacacgctcatacagatacagatacacatgcccacacagatatactcacacatgctcacacacacggtcacacagatagactcacatacttgctcatatggatgcagatactcacacatacacacatgatcacacagatgtacacacatgctcatatactcacatacacttctacagatacattcacacaggctcacacagaataacacacacaggtttattcacaggtttattcccagatacattcacacacacacagatacacacagatacattcacacacacagaaacattcacaaactcatacacactcctatagatacactcacaaacacacactcatataccttacagatccagtcacatgctgccactcatacactcacagactcacacagaattacatacaggcctatacagatcacccacacacatacctgcccatgcagaaatgcacatgggctcagatacactcacacatccatacagaaacacacacactcacacctggccatacagatgcactctcacaaataactcatactcacatacacacaaacacacaaacagatacactctcaaatacacactcaatgatccacacacattcacacatactctcaaatacacatcctcccacacaaacacacacagacacactaacatatacacacacactctcatacacactgtaacacatacacacactgaaatacatacactttttttctttttcttttttcttttctttcttttttttttgaaacagaatctcactttgttgcccaggctggagtgcagtggcgcgatctcagctcactgcaacctcctcccgggttcaagcaactctcctgcctcagcctcctgagtagctgggactacaggcatgcaccactatgcctggctaatctttgcatttttagtagagacagggttttgccgtgttggccaagcaggtctcaaactcctagcctcaagtgatccacctgcctcagcctcccaaagtgctgagattacaggtgtgagccactgcacttggtctcaaatacatacactttcaaacacacttgctcacacacattgcacctgcattttctcacacacagacacaacacaaaagcaactgtgtgactcccctgggcaaccagtcccacttttggggcctcagttttcccacttgacattctatgcatgaaccaggcctgtgtcagtaacacacagcccagagccaggcatggagcagcagcttggctggtgtgaactggactcacgtccacactcatgtacactcactatgctgtcacactcacctgtatacacacatgcaacgtagttcacacatttgtggtgtatggacataagaacacatacaaagtcccttacacacatgcacactcatagctaccacctcacattcttattcacaccccctcccacaaccaaattatcccccagccttagaggtgcaccccaaccctctccaggccctagatcctctatccaggcaccagctaatcacggagcagacagtcctccaagctgttattggaagcagggagggcagcaggcgtgggggtgaccgcaagattaattctgctgtggggaagactgggcttcttgtctccctgccagtagaagagacaagggtagggcgggggagtcgatgaggcattcagagcctctcccaccacccactccaacctgccgagcaccaggtggtgacaggtggtgcccggggcctgtgcgccaggtggagtcatgcaccagcagccccatgctgcgccccataaaacccaagctctgacacctgatgtcccccaacagtccccagactcccatacaggcaacagaatggaaggagaggctgtagggcgtgtgtgtatgtgtggtgtttgtgtgtgtatttctgtgtgtacctgtggtaggtagccagaggtggggcacctaaggggtggtcctgctttcgtgggatcacatgcagatatggaatgggtgttctgcctaatcaagggtcacacaaaccatctatcagtggccttctcaacgcctcagtaggccccctcctgaccccttctctaccaccactggtcttcccaggaacaggggagtcttggcagtggattgccttgggatagattccagatctgccatttctttggtcatgtgattttgagctaatcccttcacctctttgaacctcagtttccttatctgtaaaatgggacaaccaccatactgacttaaatgacaggatttctcaaacttggcactgtagtcagtcattttgggcaggataattctctgtagtgtgtgtgtgtgtgacctgtatgttgtaggatatttagtagcatccttggcctcccggcactaaatgccagcagcactaaccgtcgccttagttccaaaactgtctccagacattgtcaaatggaccctggggcaagattggttgagaaccactcgtataggatttcatctcatgagaattacatgtaataaaaacaactaatgtttatgtgcatttgctctgtgtccggcattattctaatcaccttaggtgaattgcctcatttaatcctctcaatattcatatgtggaaggtcctgtgattatacctgttttatagatgaggagacagaggcacggaaaggctaagtaccttgttgaaggtcacacgtgtagaaagtgcatagccaggacgctgaggctttgcagccctggacagcaggggctgtacagggaaggtggggtgtgtcatattctccaccctggggggttggaaagagagaatggaaggcagacagaggggaggaagagagcgaaggtgatggacagggaagaggagagaaagaagaaaaggagtcccagggaaagagagacagggagaaacctagtgagagacaggaggaaagagacagagaggaagggaagaaaggaaggtaggggaggggaagggaggggaacagacagagagggagactgaaagggacagaaaaacagagaagggaagattgcggggggaggtagataaaccagagagaaagccagagatacccagaaagagacagtaagagagaaacagagacctagagagaaacaaagaggaagagaaagaaaggagggaagaaaaatgggcaaagaacaactgagagagcgggaacagacatacagaaaacagagagggagacgcaggaagggtgaagaaagatggtggggggtggggaggggagggcaggtaggcttacagtgcagcagccaccaggccagggagcaggggatcccaggtggaaaggtggagagggagtgactttagccgagcacttgctgtgtgctaagctttgtgctggtcacttgccatccaggacctcagtgaatgtacaggattcgtggtaggatgtggagtcactgtgtatctatgggcttgggcaccaaaggctcagtgtcccagctctgagtgggggctggagcaggggcctggctccacctctgtgagtgagagaggctccacgtggctgccttctttgctgtccctgtcacttccagctcctgaggaactggggacacgacactcttctcacttggaaactggtcctgaagccttgtggtgtgtaggattcaggtgccatctctgggtgtgtgtgagttgggccccctgggccttgttctcgggatccagggaacagggtaggttgctatggtgacagtgcccagtgaaccacaccttccggtatccacgcccttgggtcattccctcccacactgactctggccaatgggacatcagcaagtgtgctttggccaataggacatcagcaagtgtgacaaaagcagaggtttgataagcccctgtatgctgcggcctgtcctcttggaatcctgagaccattgtactgtgaagaagcccaggataaaaggccacatggagagggaggcctagtcctgccagctgtcccagtgaagtcactcccagcgacccgacagctgactgttgctgcatgagtgaccccagcaaaataactgccaagctgacacaccaaattgtgacaaataataaattattgttgctttaagctaccaggttttgggtttttttttttcttttttttttttttttacatagctctagatgactgatagagaaatccagttggctgggccattcctctgctgattttgtctgggcttactcacgcatctgagcctaaaccggaggagcagctgactggaaggtccaagatggctcatttacatgtctggcagttggtcttggctgtcggcggggacacattggttctttcatcctccagtaggctggcttccttacatagcagtctcaggactgtgttccaggacagtaaacgtgaaagctgcaaggtctcttaaggcctaatgtcagaatttgcataacatcacttctgccacattctattggccaaagtagtcccaggcgaacccaggttcaaggggtagggaaacagactccacctcttgcccagaacagtggcaaagtcacattagtaagcagccgtgtgcagggcggggaggaattgataacatattttcctatctactatgttccactccactgtcttcctcctgatgttgggagaagcacggtggagactattgccctctgagagatctaggggtacaaatattccaaaacagtccatgaagttgttcttgaaagcttctggctctttgacttcatccgttcactcattcattcattacagtcttgccgagggcctactacaggtgctggggctgcacagactcagataggctgcaggaggactctggggccagacagatatgggctcaagtcttctttccaccatttacatgctagctgaccatgggcaagttcctgggcctctctgagcctctgtttcctcttatgtgaaatggagacacccacctggtagggctgttgagaggactgaatgagaggaagcttccagcagcaggcctcacattttggagatgccttgctgatctctttcctcaagttctggattgagtacctccataaacaagtttcacagaggcagaaatccatgctggtcttgttcatcccgtgtctatagggcctggcacacagcaagtgctcaaatgacgttttgactggctgactcccagtgcccctccactgcccctctcacagcctgggtgtagctatccatttgcttctctgctggagcagaagctccgtgagggcagaaaccaggtctacttcattatcctgaccccaggatctggcacttagaaggtgctcaacaaatgttagtttcattccctccctgtaaaatggatgactctggctcagttgacaattttcagcagagatcttgaaatctcggagaacatttctattcctgctggggtggtggtgggcgggggctggtaattataacctggcctcagctcccgcagccttgtcttcacccatcgtccccagttccagctgttgtcctggcctcccctgctgtcccctccaaatgctgcaaaaggggccctggagcccgtgtgatgcctcattagcacacaaatgccatccctgtcgcccctgtggggggcctgctggcaggcctggcctttaaaacacacaagttaattcctcctctggcattggggcctcgcggcgccccgcctcctcccttccctcacaccttcctcccaggccccgttccggctctgctccctgctatctgcacagcaagaacagactgtacctcgcagcagctgctaaatatagacccgcatcagcagaatattcctggctggggaactagagctggggctgggaatggcaccagggcagctcttgccatggggctgtgggcaaggggaggcaaaacctggttcttcctgggacgtgccagaaaggaccctttcagattgaagagttgaggggctctggagcagggaccccatttgaactccttcaactgccttgcctggtcctcactttctgacctcttgggaactgttctgctcccccaggcccggtggcctcccagttgtcaccatcttctgggccctctgctgcgggggatgctgtttcttagaaactggctgtccttcccactctcatgtcctccccactctctgatccttcatctgcccagccctgccacctcccaagactcagtcttggcccttctcttatttctatgttctttcttctccccatctccccaaggcttatcaaccctagggtccccacctcctcaggctgaatgcatgaaggcttcctcatcaccatcactatccttttgtgctggggctcaggctgagcactttacatacttcctgttcccttggcctgcagtgttggtccccagaaatctgcatggctcataccttcactgcacttggtctctgccccaaggtcacttccccagaaaggcctgttgtgatttctttctttttctttctttcttttttctttctttctttctttctctttctttttctttccttctttctttctttctttctttctttctttctttctttctttctttctttttctttctttctctttctttctttctctttcctctttctttttctttctttctttctttcctctctttctttttctttctttcttcttcctttcttcctttcttccttccttccttccttccttccttccttccttctttctttcttttctttttgagatggagtcttgctctgtcactcaggctggagtgcagtggtgcgatcttggctcactgcaacctctgcctcctgggttcaggcaattctcctgcctcaacctcccgagtagctgggattacaggcatgtgccaccactcccggctaatttttgtattttagtagagatcgggtttcaccatgttggccaggctggtgtcaaactcctggcctcaagtgatccacccgcttcggcctcccaaagtgttgggattacaggcatgagtcaccatgcctggctgtgaagtcttaatctaagtccttcctctgcattaggtttcgtcctcacactcgtcactgcttgacgttatgttatatgtgtacatgctcatcttctatattctctacttcaataaaagtgccatgaatgcagagccttagatttgcctactgaagcattcctagtgcctagcacagagccaggcacataataggcactcaataaatagtggttgaatgaatgagtgaactgtcccattgaatcctcacgaccatcaagtgagatgggtatgattctctcccctgtgcacatggggaaactgaagctttaagagacccaaccattcttggagctccacacctgtatttcacatggcctgctagaagttctaggtgtttctttccctgttttcgctcatcttaaagccaatatggttaaagctgaattttttagctctgcatcagattccagggcacattcactcattcctctgctctagtagctttcttaatttacactcctcctgtttctgttgatggtaccccttgcctagatgaataaatcctactacatggaaagaaactctgcctcctcccccaacctagtcctgcagattcgtgttggcccccaaggtttgtccttggcaggatctcactgccaccccctattctctcttctcggcatctcaatcaatcctcactatgaattcttcatcatccctggcctcctagctagacaggtaggttaaggagtctgagtgactgtcaagaaagggcgcaggcttttggtttttgccatttgggactctatgctgggcatcctgggctccagggcctccctgcctctaattcctgcctctgagccaagctctgtagcagcagcccaagggatcttgttaaaattaaaaccagagcatgtcatttccttgcttagtagtcatcagtgaacctgcactgtaggtgaggaggaggggaaatggatactctcacacgtggctcacgggagtgtcgtctggtacatttcggcattatctatcgagattccgaatgcatgtgctctttgaccaagcttctccacttcctgaaaattatcctgcagatatactcacacaagcacaaaatgatgtatgtgtgaggttattcactgtagcattgtttgttgtagcaaaagattggaaacagcataagtgtccatcggcaggggactggtgaaataaattttagtgtatccataacacccattaaataagagaaagaggaagccctttatgtactcatatggaataatcttcaaaatgtattgttaagtgaaaaaggcaagccgtgtgtatagtgtgtttatagctaccattcatgtaaaaaaaataaatacatgtaccttattttcttgtacatgtacagaatagctctggaagatgcatgagaaaattacattggttgccttggggatacagactaggtggctgggggactggatggggtgaagaattgctactaaattcctgtttggactttttgaattttgaaccttgagatgtattatctattaaatgtgagttaatattttcgagtgaatgagtctaagatctcataggatgtatacaccaagtggctacctttggggctgcaattactggtgatagggagtgggaagcgtttcttttttttttctttttagcatttctttaatgtttgaatgttttataaaatgtattacttttttggggagaaaaaataatgaagatactttgtgtgagaaaatacaattacaactgtgctcatggattggaatcctctcccttctcccccagacaaaggaaacagacaaacaaaaacccaaaacccaaatccatcaactccccccaaccccacttcccagctttgcccttagaatgaaatccaagctccttagcctggctcacaccagcacagtcaggcccctgccaccctctcgacgtcacctctcaacaaacctgattgccgaagcctgagctgcttacaattcccctcatgccccaggctgttccacttctcccaacttttgcctgagccataccctgtacctggaatgcccttctctgaaatcttggtctggcaacaccttcttcttcttcttcttcttcttcttcttcttcttcttcttcttcttcttcttcttcttctttttttttttgagacagggtcttgctctgttgctcaggctagagtgtgatggtgccatcatagctcactgcagcctcgacctcctgggctcaagcaatcatcccacctcagcctcctgagtagctgggactagaggcacctgtcactatgcctagctaattttttcttttgtagagatgggttctctctgtgttacccaggctggtctcaaactcctgaactcaagcaatcctcccaccttggcctcccaaagtcctgggatcacaggggtgagccactgcacccgcagacactttcttatcctttgtagattgctgctacttcctccgagaagccttgcatcctaatccctacatatctgcctatcctcctgccccacagggctgtgagcctcacaatggcatttgataaacattctgtgctgtctgacatctcattccccgccttcacccaagccaggcccctcctatcccaggagcagtgagagcaccccgctggaattggcagccactcccagctgtgtgacctcaagtgagtcacttcacctctctggtcttcagtcttctcatcctgtcctcctcgcactcccccaaggcttctcagagattagtcaggttctaatgtcaccgtgagtgaagtggggacagcgggtgggcgtgctgcaccatcgtttggtggtgttgaggggataagcaagaaagaagccactcttccttaaaggtctctgtgtcttagacacctttccttaaagatgcttgtgtttttccatcaggtccttaacaactgccatgtgggcagagctctcaaaactgctgaaaccagccgtcctcccttccccaaactacacttgtgaccccggaagagctcaaacgcctgcttcaacttagctccaaggacaagccgcttagttcggacctttaaggtccttttagggcacccacagcggctgcttcctgcctttcggtttctcttccagttttggaagaaccccccaccccattccttttctgttcctcagtccgtccatcttcctgcctggctgcccctccctctccgcgaccctggactctcctgctgtgcacaaggtgccccctgtgctgtcctcagagcttctgggacagaaggctcagagcagacgtctggggtggtcctcgtcccgccccgcccctggccccgccccacggctccgcctctggccccgccctgcccctcaccggtcttggggtccacggtgaagtggtgctcgccgtccagcacgctgtacaccagccgagcgctgctgccgtacgtggggtcatccgcatccgaggccatcacctgcatcaccgacgtgcctgggcccgggggaccaagcgagacaggggtcatctggggctgcggagctcgttcccccacttcgcctcaccccagggaagctgggagaggagaccctcgggagacctgcgggaggccatcgaatacagcccctcacggtccccatccccactctgagccccaaccctcttcctgttttgaggcctttctggtggcgcaagtgtgaccatggagtcagatctggattcaagtccccttggggtggttcccagctgtaggactctggcaacgaaaggcagcctctctgagtctgtttcctcttcagcaaagtgaggcaaatcctagtgcttggttcactaggttgaggggatgaattctaaactcccagcacagagctgttcacagaagtttctcaatgatggcgacaatcattacagtcatcacagtcagttggagccaggactggaaaccaggacctgactctcaacccaggggccattctacccactccagctcctactgattcttcaagggacttctgcctcctctccccgcatgatggtggtaggggacagcccagagggacagaccaattcatcgggggtcagaggccagtgtctcttggcccccggcaggagagggcagcacccagccttccctttggaaagttgttggctgcgggccctggtgccctcctcgcccctccccctgggtgcccagacagcccacccccagacacacacacttctcatgctctgcacgtagactgctggggagagtataaattggataaaagtccatcaaacagtggcaattaagttattgatttttgacgctgcctcattaaaccgggagcttcttttggtctgtcccagagatggctctaatttgacatcatgttcaatttgacgaaagcagggcttgggacgtgaggctagaccaggtgggggtgggggtaagggtgggggagggtcaggtggaggggccaacaaagccattgaatccacccaaacctttccagaaagaagagggtgagctggaagactcaagagtgagtcttgggggttcaggatacgacccaaagggaaggagatggagaccccacctcagagagatgccctctgctgggtgcctgctggtggggccaggcaggcccctcctgggctgggctgggctccctgggccagcagggctgcatgctgggaggtgaggccagttcactgcctggctaatgagtgagaatctggaagtgctactgcagcaattctgctaagcccagcccgccgcccgcctctcccgcctccagcctggggccctcgatcattccagacagacacatgtatttatttttcactcttttgcatttctcatttccctctccaggttccccctcccagccacagtctcctaaaacgtccctgcaatgcgcctctctctttggccactccagctccatgtcaaccatgtcagagttgaccagagaagctgaggaagagggatgggcaagccccttccctccagatgctggtgcccaggggtctcctactcagggaggacacagctccaggtgcctcttgctggactggaattatgtcctattgagcactcatgacacactggcttcaccagccacttaaatccatcatctctaatcctcatagcatctcggagatgcagagtggcccccccccccaattttacagctgaggaatcaagtcagacaggggaaaagatttcactgagggcacagagtgaggaagtggtggaatttgaacccgggactctgggatgccaagtcccttctgggaagcagtatcagcacaagtacagtgactttggggacagtggtctggtgtactgagtcacaaccagcgatggcactgccacttattagaagtttgaccttggatctgtcatgaaccgctttgtgcttcaatctccccattttgtgaaatgagggtggtagtattacagatctcctgagatcattttgagaattcaatttccacgtccagcaccaaggacagtgcctgaaccatgccaagaacccaataagtgcaggttgttgttgtcaactcaagaggcacagcacaccagtatacaatggcacaattatgcctccctcacagaggtgctgaaatgggagaagatacataaagcatcaggcttatggtgggtgcacaatatctagtggctgttgtaattgttatgagagagggtctccctgtcactcccctggcaagtccctcccactccctgggcaaagcacaatgcagggctgagtgactccccagagacatggctgagctctctctctccctggctgcatcccagggactcccgaggggatgatggaaccatttccccaatccaggattctttattgcagccattatagttaatgccgacatgtgggaatggtaaagggtcagtgattcaccactggtttcccaggccccagaggaatggcttccttgggccacacaccccctcccaccttcttcagaagtcagcagctccccagaattggctgacaaaagggtgccaggcttgtagctactgtgggaccaccttggggtggtcccacaggttcagcagtttatatttcacagtgccgcatcatgtccattctctcctgcagacttcacaccagctctgtgatatagacgcagtggtttgttggtgagtcagctctgaggggtggatgggtcgggaggagtgccctgctttgtaatgtttgctgatttccatggtgtaaatattctctccatggcccagtttcaagctaccaacatgatatcaactggcccacaaaactcctgaaaatcaacatgtggctctcgtgagctggtacgagctgactccagcacacccctgcaccatccccatttcacagctgaggagactgctatgcacagtgaagggtgaaaacatgaattaataatgaaatccattatgaattatgtaacattattcaataactgataaagatagcttccatttattaaataacaactttgtactagatactatgatataagccctttttgtatatgatagaatttacaaaacagggccttcagataagcttttaatattttcactttaaagaggaggaaatggaggctgagtgaagttaagtaatgaacctcttagtgcttccatttcctcattagtgagatgggtaagaatactaccaaactcgtggatcactgtgagaactcagatttctatgctcagcaccaaggacagtaccttgacaagctcacctggtgcaggagagaggcaggtttcaaacccacgtggatctgatgtcaaagcccacatatatcctgccttagagggaggaggaggggctgcttggagtagaagtagataggtgagacagagagagggaggactcagacacaggagcaggggggcagaggaggggaaggacaggagctgggtttagattctccctcccctacagctggtccaagcccagacttccagaagtagagctgggactggttgacaggagcgggctgctgtccgtggtgctgctgcccagcccttctgctaagtggtggttaagggcctaggtccaggctggaatgggaagggttgcccaactgattcttggctaaacaggatctcagggcccatggatccatgtggaatgttagatatggaatggcttgtccttgaagagcacagaaatcagagcttctcaacttggcagcacgttagaatctcttgggagctttaaataacattgatgtggagccccatccctgaccaattaaataggactcttggggaggagcccaggcaaaggtattttcacagtctccagagtgcatctaaagtgtctctcggtctaaaaactgatgccctagactgaatccctcactgaactgatgaggaaattgagtcacagaggggctcgatgacttccccagggacacatcattagtaagcagtagggaaagattcaaactcaggtctgcctagccagcatgctgccctcctggactcattgagcctgttctgagactgacacctgaaggaagcaggtaggataatgttgccaccaagtcattagagctcttcccagctgaagtcagcatgagaagtcggacactcttcagaggagatgccctcgcatctccatggagactgggtgggctttggcatcacagagtcctgtggtttcaggtcctaccacttcctcactctgcaccctcagtcagatcttttaccctttctgatccatttcctcacctgtaacattaaggggtgcccattctgagcctctgagctgctatgaggattagaaatgatggatttaaggacccagtgtgtcgtgggtgcctaacagaagctcattcctttcccttctctccgtatcatcaggaggcacctggggctgtgcctccctgagtagaagacccctggacaccagcatcaggagggagggggcttgcctactcctcatctctgtgttgttctgacttggtttgttgtggaacaagaattggaatatgtgtcctggatcccaggccagaattctttttttttcttatcccttaatccttgctatctgtgaagtgcagttgagtctccagactcaagttccagaccccccaggaggagccccccagctggctctgggagtgggtggtgctgcatggagtggagctcagggattacagacatacattctcattccagccctgtccttggctttgtgtggctgtggaaaaacttcccaatctgattgggcctcagttccccttctgtaaaatggagataacactttatcattcctgtctccctgggtgtgggagaccccttaatgagagaaagagatgaagcactttggaaaagaacagagttctcagccgaggtgaccacatgtcattattatgaagacgtttgtaattattatcatcctgcctcttccctacctccttttgccaccccactgggtctggggaaaccctaggctcacatttagcttctcaaacatttataaaaaatgagtcccacccctgctgctgccagcactgtgcagaatgctttctattaaaaattaaaaaccacttgtcgagtctctgggaacgctcagattacacaggaaacaagccccctctcaacatccacccctgctgccctcctcccaactccctcttcgatcatcacttagaatgccagctggctgggctggcctcgaccctgcttctagcctcccagccagggcagcctaatgcagatgaatggcacacaggagatgcaggaaagtggctgcatgggaggaggcaggtccagagacaagtgacagagaaggcagcacagagagaggggtcaagaaagcgggtaagagacagagaaagaagggtcagagggacagaagttcgtggggcagagacagacagaaagcagtagaaacacagaggttaagtaggaaaccagaggaatctagaaacagagacagagcaaatagaacagagacagaggtacatatggagcaggaagagggggcagagcaggaggaggaactaggagaggaaggtgaagtttggcctggtggggtgaggggcctgctgcattgcaccttcctccagagtctccagggaacgtgaaacaccctcccctcctcaccttttctttccttatggatcccggccatggacttgcccatccaggcgacccctgactgtgtgtgtgtggatctgctatgtcctcctgagagagagcactctcttatatcccaaatagacccacaagcgcttctgtcctctcaacatttaccaggccctctgttatgcaatctagtgactttgtttgtttcggactgcaacatttgaagtatctgtgatagcatccttctactcatggcagaaagcaaacatttttgcttatgattcaattccattcattctctcaacatctacagagcacctactatgtgctagaccctcgagggcaggatggtagctttatcatctttgcaccctaatgccatgtggccacagggcctggcatacagagagtgctcatatttgttggatgatttgttgatggaaaagacaaaaagagacagggatatattcctccctgtccagattacccgggccatggggccaactcctgaggaccagggcctcggctcctgtctgctgcttctccccaccagaagcctcctgtcccgttccccccagcacgggtggtgagagccagtgccgttgctaggcaaggagatattgcacgtatagatcttcctggactttaattaaaaacatctttagaagttgtctctgcagagaccagcgattgattcctggcttgggcctgcgggctgctgagctacactctctccagctacagacgggacaattggaggctcccagcctgctgctgccctctccaaatgatatccttggggaacacactccttcctgccttcctcctttcctctctgttcccccaagcaccgaatttaagaatcagatagtgtgctctcccagttttactttccttcccctcttgagcctcagtttccatagctgtaaaatggggatgtcagtacttaacccaagagagtccccaggaggctgaaatgatattagggatgtgaaagtgattttcaagctgtgaagttttgtgcaagaaatgattgtgactctttcctcaaagaaagctatggatgccgagccaaggaactcaggttctggtttccgcttctgggtctagttctggcttcagctcttactgtggaagctcagaaaaatcactttgcatttattttttcattagtaacatgaagacactaatactgatcctgcttattcctcaggattgtgagaataaagggaaatagctctgtgaaagcagtgcttgctgatagctcttatttagtgaatatcccaagaagtgcaggctgtactaccaagacagtcttttcccatctattaaatatgctgctcacagaggaattgaaacacatggaaaagtgcccgtttccacattctgttgagccccaatcccatggtctggcaatgtcaattctatggcatgtgcgctatgacattctccttcctttgcccatggcagacattactaatccatcatggcattttttctaccaaggctgaatgagatcttagactccttctcaatacagcccaacagtcactaccaattgatctgagttagcacaagagacgaaactgatctgctaccactttgaggtcaggggtggtgtcttgctcatctgtgatctctacatacctagcaaagtgctatgcacatagtaggcctaatatgtgtttattgaattaaaagcaactacttctctgtcctctgtggggctatatataaagtaggtgctaataaatgtttgctaagttgggtgactcatctttgcaagccctacagagccaagtacattggaggccttgtgtataatgggtgctaataaacatttgtggatttaattcaattacttatctttgcatcctctgcagtgcccagaataaagtagtggttaataaatgcacattgaattgaatttctcatttctgtcttcagtaacttcaatagtgccaggcatagtgtcttgcacaagattggcatgaataagtaggaggagttgagctgggtgtgggagacctgtgaaatcctcttgccatcccattcaggttgtgacagcctagggaaggggtgtggctccctgacattgaaagaatgtctagtccaattcttctctatcaaaacttactccctgttgatgtatgcagcatcaagctgtaaattccctctctctgctgctgacttccaaagttgtatctttagcctcatctctcttctgacatctagactcatagatccaactgtccccttgacatatgaacttggatgttcagtagacacctcaatcttaacttgcccaagaattaattcttaatttgttctgcaaacttgctcttcctggagcagtccccatctcagccgcagtagctccatccattcagttgctcaggcccaaaacttcagcatcgtccttgtctcctctgcctcttactccccacaaccaatccctcacaaaccctgttggctctaccttcaatgcacatccagaattccatcttgtctcaccatccacactggtccaagtcaccatcacctcttgctgcactattgcaattgcttcctcattggcctccctactcccaaccttgcctcctacagtctattttcaacatggtggacaacaagtcgttcttttaaaatataagctggattagattaaacctctgctctccatctcactcagagtacaaccaaaaacctttcaatggctaccaagtcctgtgtgatccattgtctgaggtaatcagactccagatattctcccactcactcacttctcttcagccacagacctccgtgctattcctcaaacacgacaaacatgctatgcctcaggacccttgcatttgctgttctctctgcctggaacattcttcttgtagcttagtggttgtccaagtatggtctccatgccagcagcattagggagtttgttagaaatgcagacatttctaacagcccagacctcgtgagccagaaacgctgggggggacaagggcagcaatttgtgttttaacaagccctccaggtaatgtggatgcaccaaagagtttgaaaaccactgtttcacagagctccttggttcccttccttcagatctttattcagatgtcctcctccagaaagacaggacttccctgacccctctatctaaaataacactccccgcaaattgctcctaattcctttattctgcatagcactcacaccatcaggcatattaatattcattttatatatctatataaatatatagatatatatttaattatatataatatataatatatttatatataaatatataaatataaaaataaatatatattatatataaatataatatataatatattatatatagatatatattaatatctatatttgtatatatttatatattaatatctatctatctatctatctatctatctatctatatatacatagagagagagagagagagaaagagagtcttgcactgtcactcaggctggagtgcagtggcatgatctctgctcacggcaatctctgcctccccagttcaagcaattcttctgcctcagcctcccgagtagctgggactacaggtgtatgccaccatacctggctaatttttttcgtattttagtagagacggggtttcaccatgttgcccagctggtctcgaactcctgagctcaggcaattcaccggccttggcctcccaaagtgcgaggattacaggcatgggccaccgcacctggcctattttatatttttaattatttatttggatattatacatttgcttgtctctgtcctgactctccctgctatagtatgtaggtttcctaagaatccccaatgcctgaaacagtgcctggcacatagcaggcactcaataaacatctgatgcttgaatgaaccctctcaatgctcagaagggaacttggggtccagagggggcaggaagtcgaccaaggtcctgcagggaaccaggcgtcctgactatcaactcagggcccacttggctgcatcaggcttaacatgactggtgtgcccctgctcagaagcgtggctcatcggaggccccccggcacacttcccttcccttttaagctgtgagtggtttaatttgcaagcgctgctgcctttcatgtcccaagctgcgtccctgctccctctgatctccgaagctgcccagaccctggtgctgcttgtcggccccgccctccacagccggatcaggaggctcagtaattgtgactgattttcaaagctgcctggagtctctgcaagcaccatggtgtcagatttgcttccccttcaaatagttgctcaaatgaaataaactaatttaatttctgcttctcccttccccctccttggttcccagctggttcaaattgagtcccccccactcccgacatttttcctgagtggactgtgagagtcagtgggctgggagagggagtcaagacagagctgggtctccataggccagtggtcataaactgggggctgcctctgcctcctactctctgcatgaccttggatgagtccttgcccttctcttggtctcagtttccccacctgtgaaacaaggacccttgccattccaacaacctgggagccacgcccagcaacttgctctgtcactgacttgctatgtaggtactttcttctctctgagcctcagtgttcccatctgctcaatggggatgctaccattagtcctgccacctctcagagtcacagtgagagtgaagtggtcatggaggagccaccatggtggagatgaggctgctcttcccctggcacctccccatcctcagcccttctccacagtgcagcagagggaattttccaaaatgcaagtcttcccatgtcactccctcagttaggcctttcccaggctacctgctttcctctagtccttcagatggggctcctgcttccttctctagcatcagctctccccacctttctggactttttaatgcagaaatgtgcaggtcagttttaagtgaagggagacagggctgtgagtttaagtcagtaggtaggggctgccggacctagaaagtcagggacttgctgtgtgaccttggacatgtcactgtctctctgagccccagtttacccattagcaaaattgtatgctaagttcttgccaggctctgaaattccatatgtctttgccattgataatatccaaatttatctctccagcccagacctcctctgaacctggatattcaactctcttgttcaagatctccactcagcagcataatacgtttttctaacttaacaaacttcacgccaaactcctaatttcctctcatcccccaaatctgttccttcaatctcagtaaatggaaatccatctatttaattgctcaggttacaatcctaacagtcatccttgagttttctttctttcacactccatatccaatccattagcaaatgctttcagctctacttctaggatatatccaaaaggcaacctcttttcaacacctccactggtaccatcttgttccaagccaccatcacttcctgttcacaggccacctgcttctgctcttgccctcttttctgcccatctattcttcatgaaagagccatggggtcctgatcatgtcatttttctgagcaagaccttccattgacttctcagcttgttcagcataaaaggcaacgccctggctatggtctacatggctgcatgatctggtcaccttgtttcttctcagcagaattcaactgcagggcctttgcatgtgccattccctccgcctggaatgctcttccccccagggcccatgctctcacttcctccaggtcttcagagaagccttactggaccaatgatctagttgttcacttgcttattgtctgtcttccttaggaagaatgggccctccatgagaggagggaatcttctgccttttcactgctgtgttcccagggcctagcatgtagtatgcactcaataaatatttgttgaatgaatgaatatactcatatagacacagcatgtcacatgcacacacaggccttaaagtgcttcttggttaggtgtttgtgtgtgcacatctgcatatatatgtggaacacacatgtacatcaggcatgcatgcatgcattcctgtgtgtgtacaccagtctgcactcacatccacagccccactgttccctatttccccctcatcccttgcccaccattctctctggttcacctcctccccttcccctactggctacttgctcattatcccagcaagctgccagatttggcccaatttggggaagctgggctgacagcaccctctcccaggagctcaagcactcctggcctctgacacgcagccatagagctggaaggtccagagaggtacagcatccaacttttggccacagcgagtcagcaatggagcgtggcttaggacctagggcagctgcttcttgtctagcctggcttgcagattacttggagtaacgtggtaggaaggagatggcagctattggcttgtgcccctcaccccatgactcccgtttctaccagagccccaggagccctgagctaagtggggccttgatggtcagaaacggtctgggggtttcctggtgggagaaggcagagtcatgcagctttagcctcagtgtcctgctgctgtgtgcatggccctttctgagtatggttgtgtctgatgtctacacagagatgtatatttctgtgtgtgtgcacttcactttctatgggcataatcatgtgtgcagtgctcctgggtgtgtgcagtcatacccaggtaagtgcaactgaatctgtgtctgggggcttagccatctctgtgtgaggctctgtccctagctggctggatctcggtgagctgtggcttcctctgggctgtagacagagctgcctgtctcattcatctgcctgtgcccatgcctgtctgcggctgcacaccaggggagctggaccccaggatgctcatgtctgcttgtggcttttgcctctgtctctgtacatggctgagtctgtgcagaagcactatctgcgtaagggcctgtttcctgcctggggttgtgtgtggctaggtcagggtgtgaggtcgtgggtctgagtgtgtggttgggccctgtttcagctgtgtcccaatctagctgttcctagtggtgggtgtgcctgaagatgggactatgtctgtgtggaggttgttgccaagggctgcgctgtgtctatgtgcagttgaacttttgtgaagggctctgtcaaggcgtccagctgtgctgtgtgtgtgactctgtccagctgtgcctgtgtaggggactggatctatgaatgaggttgtgtaccagtgtagtggtgagttgtatgcggggctgggcttgtgcatgtggcatgtccagatctgcagctgtgtctccatacgtgactgggtgtggctgtatgagcatgtccgagggcatcactgtgtccacatgcgggtccacgttcatggggggctgtgtccatggatgtggctgaagtcatgtgtgtggttttgtccaggactatgcttgaccccagggggcacctgagctcacatctgtaccctgtaccctaggtcagcaggctctgtcttttctgtccctccccagaggatcagctactccccttcccagcaggctccacttggggatcaccttgatcccatcccccacccccagggcccacagcccacctgtaggtgagagctcggccacgctgccaatataggggccgtgcaggaagcggggctcactgtcattgatgtcctgcaccttgatgatgaactccgactcgggctccagtaggcggttggtggcgcgatcccgagcctgggcccgcagcgtgtagaaggttttctgctcgcggtccaggcgctccatggcatgaatgtcgcctgtcagctcgtcgatcaggaagatggtcccagcaccctcgcctgagatggtgtacttgatggccccgtcaccctcgtctgagtcggagtggatctgggtaggcagagaagaaggcaaggtggaggctgagaaggaagctcctcttggcctcactgtctcatgccattggctgcctattcctaagcccatctcttctccagcacatacacatctttagtgaggacactgaggcccagcagccacgctcacttccatccctggcctggagtctttcctcagcccgctggggccctccctgcccctggactctgctttcccctctgcattcagagctatcagccttggaggcagatctgaacatggcctccctgcttacaaccctccagtggcttcccattgccttcacaaagaagtccagcaccacctccacacctctctcccctttagcacgcacagctctgaggcttctgccttgagccctgtccttgtttctctgcccatggaaagtctctcatcctgcaaagtgcaacaaaaatgccacctctttcagaaagcttttctggatcctcagtctccccctgcccccaggatctctcggtacatcaagccatcatgatcatgttcagccttgtaggatggctgtagccagcacttctcaaactctagtatgcatgcagttcacctggggatcttgttaaaatgcagattctgactcagtaggtctggggccaggcctcagactttgcatttctaacaaacttccaggctgctggtccatgacctcactgtgaattacaggtccactgctccctagactctgcaccccaggagattggggtggcatcttcctcattttggtatatggagaaccaggctcaagacatagcacatgacagggagtgaagggagagaggaggaagggatgttaactgaaagagcaccttccatgtgccaggcactggctaagcaatttatgtacttttctagttaaagatgctttttttaaaaacctgctagagtaggtttttctatctttattttacagatttttttcccacttcctaatgaagattggagaagtgggatgggttcttcaaggtcaggccactggaagagctggtctgactccacactgggctttcccattccatctaaagcctccggagaggagcccaggggaagggagagacagtgcagcctggcccagccttggctctgacatcgcctccctgtgcatcctcacccatcactttgcctctctggccctcagttgcttcatctgtaacatgggaatcatattagcattttcctcccagaggtactgaggggtttgctgagttgagaatccatacaaggcccttagcaggtgccaccaagtgacatttacaatatttagcagccagcacggtgggggcactgcccaggcagtggtactgcagcaggatccctgctgggccaggcaggaacccttcagttgctggatcacagagaggcccagggggctgagagagttggggcgagggagaggagagggactatttactgcaggtatggaggtttttcatgattttaacaacaagtacaactgtaccagtttgtactacctggaaataagccctgtctgagacataataagtgcccaacagatggtagctatcgttattattatattattactgcatgttagctatatataaccaggatttaatctaggcactattaggctccagattccaggctgttttcactgccctgagatctcttgggtgaggaaccagcaagacgtctgttttcttgcaatcagaaacacctaagtccttatcttccaatgcccaaatctcccaggcagcttcaagcagaggaaaatccattccgatgaggctttgggcaggtccctgctcctctctaagcttccatggagatggagtgtggacaagagaatccctaaagttcctttcaggctggggtgctggggaccccagcccactaggcaggagaacaggtgcccatgaagtcatcacgaagagggacgaaagcccatcccctgccacgcaggaggagccggggtataaattctgctggtagaactttgtgtctgaaaggtggattatagaagtgccatttggaagattgaatggcccataaacattttcatatttcattagccgattaatgggcatctctctctttttggcgagtctgctgattctcagcagaaattgcggggactaaatggaggcgtctggtggaaactttccgggtccccatcctgttatagattgccccaattaatgcccgtcctgggctccactgagaagccttcttcctgtccagttactgttaatagatttctcataagtggctggattgtaaaaacctcataactcagtttaatgcccccaataaaattatttcaggacatcggccctgaatcattggcagtgctgaggatgaggagacctgtctctcctgtttgctgtttatacgttttttccaccattgccccaggggagatgggatgagagggggtgattctgttcccttttggggtgcctctacctgcttcccagcctgatctgttgtctgcttatttcatcagcaaacacttctgagcagtgtggtagaatagatgccatttgaagagatgcttaacagctataatcttactagtcttcatcattgccctgtgaaacattatcattcccatttctcaggttagaaaactgaggcacagagaggggaagtcatgtgctgtgtcacatggctaagtgtggaaagcacgcttctgactctaccactcactaatgttgggaccatggatttgtgaattttacctctctgagcccctgtgtttccacctgagaaatcacaccaagccctacttggcacaggtgtggggaggattagatgagagcatgtttacattgacctaagcactctgttaatggttgtttccttccctttccatctcctgggtctccatcatgtccctgcaggccttgatgttttgactcagaccccaggcagggctcacttacgagtgaggaatggagaggagcgagtagaacctagtggtgatgtcatcttctgtggaatatgacacagagctcacgctggggcctactggctgctctctggggactgcagagtcagacaggggcaatctgcctgggcgggagctaagatctgggagttacgaattcaggcccagctggggttgcctgccctgcctgcctgggtcccggctccagagtgaagagggagtgcctctggctctgccctaggaagatatttctcaggactctcagctgcgagtggaggctggaagatggtgctctcatttattgagaacctactatgtgtcagacatgtgttgcaggccatctgcagaaatccaacttgactttgtggggtttgtaaatgtatccctattttccaggtgaagagactgagatggcccccggtctgtttgactccaaagcccagtttggtttctctgcagtctctgggaatctggctagtctgcttacaatgcctatagcagagggtgagggagaaaaggggaaggggggaaggagtgggttactgggtggccactgggctgcacagcttgggtggtggccttgacaccagtcttttgccctgtgccgtgcaggccacagtcatcggtggcctcttctctctaagcctccattttaccacttgggaaagaacctcaaactacaaatcaggaaagattatgtgctttggagtcagaagcagctctgtaccagcttcagctttgccagcaacctgtgcatgaccctgggcaagtggctacccttctctgagcctcagttttctcatctgtaaatgggactgatattgcttcaccacatatattctgaagattcataagataatatatggaagctccttgcgcttagtaggtgctcaatatagattagttccctctccttttcctgtcccaatctcaggaggggtcgaggggtcacctaattcatcccctatctcctgatacaagaaccacacagactcaaatcctgacccactggagatccaggggccatgatccaatcaatgccttcttgtctttcaaactcagcttgtttcctcctccaggcagccctctcagatgccctctcatttggttgaagagacctcacctgctccgttcctgccccgtacacatgcccctctactccacaccctcctctaacttctagtgttgcacatctgtgtccccagctgtcatgggcctcaaggtatggactaagttaggtttgtctctgtcagaactctctgtgcctggcacacactaggtaccctgacaatgcctgcagagaaaatacagggggtgggaaagttgaatatgtgtgtgtgtgtgagtgcacgtgagtgtgagcttgcaagctccttgagggccaagcatctggctgtttattccatctccccagcacccagcacggggcacagcaccaaacatattgaataaatgaataataaaatatacaacagtcatcagactcccccagttgtcttctaggatttctggaggattcagccactcttaaatcccaggtacagatggacagtcgctgggaacctgaaacactccaggcacagttctagaccttttactgctgtctcattgatgtctcatcttgtgcatcagagcttactctctccccgtcgtgtagatgggcaaactgaggcccagagagagtctaaaccccacctaaagtcacacaggtaatgagagacggccccaaagcctgacaccacattcagaattctttctaccacatcaagtgtggccagccctggaggagaaatccccctcaagccccatcccttgatcataaacaacatgaaaaacacaagagcgatgttttctcatcccagggggctgaaaaatgggatttatgaagccattaattacttcctcctaattaaatcaaaattaaatgtgagcataggtacgttttccttattaaagacaattaaacggacagtgcggctacgcaaataaaatgagtccaggatttaaacggaaagcaaatcaaataaaaagcctccccgggatgaggggtctgttcacgactgtgctactcgtaaaccaggagttcatcaattttctttaaatattagcaacttaattaaatctgctctcctccccactttaatcctgccgtatatctaaaatagatctcaccacctacaggagttggtcatgagtgctgaccccataattctatctttttttaaaaaattaaaaatcctacaaaatccacatccagctgacagaggcctcgggggaaattatagttcggaaaacggattagtcagagtacccagattttatggaaatgctgggaggttgctttgagggtgggtgtcgtgagaaggttcggggagaggtgggccagggttgccaatgggggcagggccgcggaaggagctgtttgtgtggggccttggcgacaaccgcggggcccagcggttcctgtgggtgctgacaggagcctggcggtgagtgatggaggaggcggttgtaaaataggttaccgtcgggcgcccggggttcactctgcggatggtgctgttgctaagctacctttagaattcgacaaggacggatgctccgagcggctccctggggtggggggaaccaggaagcagtgaattaactgaaaccgtggtgaagtcctttcttcctgaagagtgagagagcgtggtatgagagtgtgtgtttgcattcatatgtgcccacacaagcactcgtacatacgagggactcagctggaaaggggacaggtggcttttaaaagcccaagctcatattcctagggttggggggtggggtgggctaatgacaaccttcccccccacttagtggtaagaaactatactgttaggttgccaaaaagactttttgggatttggggcgggagttcacagttagatggtacactcaagatggtggaactatccataatagtgagacttacaaggtgagacttaacaacataaaagtgaatacttactgagcacgtgccaggacccagagagtattctaggttcttgacaaatgctaactcactgactccccaacgccagactttgagctaggtcccagtaatagcctcacttaacagataaggaaactgaggcacagagagggtaaaaaagttggccctctgtatccgtgggttctgcatcagtgaatgcagccaacccaggatcaaaaacattcagaaacaaaattgggtctgtactgaatgtgtacagacgtttttcttgtcattctccaaacaatatagtataacaactacttgcatagtatttacactgtattaggtattatcaatactctagagatgatttaaagtatatgggaggatgtgcataggttatcggcaaatgttatgctattttatattgggttttggtatccatgggaggtcctggaaccaatcccccatcgagagatactgagggacaactgtaatgtgcccaaagtcaggaagatcataagcagccgagctgggatttgagcccacgcagtacagctccaggtggccctttaaccacacacaatgccacctctcttaagaaagtgtacattgggcaaatatttgctaagagatggaaacttcttctccctccctggatggagtgtttttctggaggtggccttgagagtaagagagcagggcaggggctctgggtgaaggtgatagagaaggagggtgacaagtcacaacagcagtggcaatgtggggactggttgctgggggaaacagaaagggccctgggcccagcacagtgcttggctcctggcagctgcttaatatgaggctcttgaagtgagcacggagattgtgttaggagacctggtttcttgggttggttctgcaactatgttgctgtgtagacttggcatgatcttctctgcctctgggcctcagtttcccctccttctaatgaagggagctacagggccctcccctgcttatagactgtggttccatgagatggggatggggtcagctcatgctgttgaggtgataaaggctaggtaggggcagatgaaggcgtgagtcagcagccggttttctcatcttttcaggatgtgggtggctggcgaggcttttgcagagccccagctgctgggcagacagcaaggctgaagtgcctgggatgaccacctcctctgacatttaggcagatgcatcagtccttccctgtctccagggttttcctggaccaaaggtcttttcccaggtctgggaatctctgaggggtctggaaaatcaggctggggttgacctcttctctttctcttttgggggcttaaaaacttcagctcaggggaacaggtgtagtggctgacttctgtaatcccagcactttgggaggctgaggcaggtggatcacttgaggtcaggagttcaaagccagactggccaacatggtgaaacctcatctctactaaaaatacaaaaattagctgggcatggtgtaatcccagctacttgggaagctgaggcaggagaatcgcttgaacctggccgaggaggttgctgtgaactgagatcgtgtcaccgcactccagcctgggtgggcaacagagcaagactctgtctcaaaaaacaaaaacaaaaccaacaacaacaacaacaaacactttaactcacacaggttcaactcttggccatgccactcgcccactctatgactttgccctctgttactttggtttctttacctacaaaagggaatgatgatttctaccttgcagtttaagggttaagtactttatatgggaataataaaaaacagcaacaacaaacaaacaagccacaggctgaacactttatgtgctctgttttcttctttaatcttcaacaaccttaggaagctggctctctgagcccctgtttttacagatgaagagactgagtgttggggcagtaaagtaacttgttcaaggtcactcagtgaagggattggcagaaccaggcctcaaactcaggtgtgtctgcctccaaagccttcattcttagctgtttcaccattggctactacctatcatatagcaggcttggtcactccatccccagcccttgccccattctaccagcgtcaccatctcccacacctgtctgggagtcaggagtcctaggccctgccactaggttgctggatgatcttgagcaaggccttgaacctatctgagccctgtctgtcaaatccttgctcagcttaattgtgggaatcattcattcattcattcattcagccacatgtatggagctttgggccaggtattactgtgtctagaccagagaaaatctgagcttcctgcaaggcaaacccaaaggtttacatctagattttccttctctccttgtcaaggatcctgatctctgagcctcagaactgcctcccggttcccacactcatttaagcacacaggaagctctggagttttctttccccacccacattgctgaccaagacttcctggaaagctaattggccctaacaaaagccagatactgtcccggggcaccaccccactttcatgccctacaatcaccctccacttcaacaccttaactgctgacaaggctctgagcaaaccagctaccttcaggtttccaagtctttgattaggttacgtcctctttcccaccagcctgatgaactcctacacgtatgtcaaaacccagttcaggtgttttctcctccatgaagccagacaaaatatactatttaatgattgcctactcagtgcctggtgctgactcatgaagcttttcatgcaccagggtgcctctgccactctggggatccccaaagtggcagaggctggatctcactcaccttttctccccagcatcacacatgggccccacaaggggctcaggaattgaatggatgaataaaagtccttctcagctccttatatgcctatgttatagatcttcagccagatttaccagcatttactcagagagtttgagaaagtagtttcattcattcattcattcattcacttaataaaccgtttgcaagcaatgtctgtgctaggcactggggatttcgcggcgagcaaaacaaacatggtctaatagaaaagacacacattaattgcacaatgaaacaaacacatgcataattaaagtgttatgaaggaaagatgctgggacctcacgggggatgtgacagcagatctgtcctagcctggtgtgggcaagaagggtttctctgagaaagtggcattggagctgtagtgtgagtgtaaggtcatcagtggaaggagcaggaaagggcagttcagcaggagaaacaacttaggcaaaggggcagtggcaggagtgtgcatgggacgttgactttcagaagagcaacggaagggcagtgaggctgaaactcagagactgtggcaggagatgaggctggaggagccagatctttgtagtcaatggatagaatctgggctagaccccagtgcatagggagctgctgaagaattttaagcagagtggagcagctagagtatgtgtgtgagatgatcggatttgcaaactcgttcctaaatcccacatgcatctagctacaggatggaatgggattgcctgctgggctctttctaagatgcaaaagggaggggaaggagaggagggcatggggcggagtgggagtgggaatggggctctgggcccccttatcagtccttggctagggagcagaagaggcacatgaaacatggatttaaaagggcaggtgaacaagggtttcttgtatctacccgtgggtgtccccagggtcctgggatctggagttggagtggggccccactttaccttgcccacatacaggggctccgtgcccgtgtactcctctaccacgaagaactggttccacacccagccgcgtttgacgcggccggctcccagcgcgccgtcctgccgagctccgggcgccgacggcgagggtgtgcccgctgcccacaggcgccccagcagcgtcggcggcggcggcagcagcagcagcagcagtagcgcgggggacagcgcgactcccgcccggagccccctaccttcgggcctcggcctcatccttggcctgcgcggggctggggcccaggagcatggacgagaggcaccagggcgccgctgcttggtcgcacaacgatgcggcgccgtgtcacatggtggcctcagcgcggccgccgggatgtcgcccccgacggggcacccggacgggcccgcggccctgaacgccgcccagccgcgggggtacccggctggagggggagggggcgcggccgcatccggggcatggacagcccccggggtgcccgcccgcgcccccgtcgccgcgtcgcgtgcggatcaccaggcagcacctggacagctccagagtcggggaagcgccatggttcctgcgcagaaaggatgcgggttggggccggcagatcctgccaggactaggggccttccctttccatcaggagcctgcaagagaaacaagaaaacattagaggggcttctgtgtagggggagggcaagttgagtctatctttcctcttgtaggtactaattaaacacctgctgtgtgcctggtactgtgcagggtgggacaggcatcatagcaactcacagtggtcccctcttcttggagcccatagtctagtaggcgccctctcccgcacatcgcagcctctcctttcacctggcatcatacgccctgtactcccaatctcctacgcctttctcacagcccctgccccgctcagccctcatgcccacacaaggagagaccctagtaggcggtgcccctgacctggctgacaatctctccagccctgcccagcccccagaaatcccccaccctaggtgcttctagaaggcatcttcaagagcccccaagacccaggcctccttggtgcacagaagtccagcacccagcccaccaccaaatatgcctgccttcctatccatcgcagcacagacaggtcattccatctgaaacaggcaccaagggaaggccctctgatgtgctcgtacccccacaccagcttctagggatacagcacctgagtcccagagggcctggcttggagacaccctcagtgactccgggcagggtcacaacccctctgagcttgcctctggtgcctccacattcccccagaaaatatttctttcccagagtccgagagacatctttcctccccactcttggaccagcctgccgtccccagatccatccatctctcttcccttctctctatcagatcctgctttcagcaggaaaggatctgagggactaacgcctactcaagccataagatgaataatggcttaatgtgggtgtttacaggggacagcgatgctgcttaatggaggaatttcaggcacagagaggagtgtgtggaggtgaggggctcaatccccacttctccttctcctgatcccagttcagctcagttcaacagctcagttccaccaagcttcaactttgtgccaggtttggccagttgccaggggcaaggtaaataagctcacagtttagtggggtggaaggtgaaacccttcttataacaacctaaatgctaggtggcatatgatcggggctataaaagtgtctgtgtggacaacctgagacctgtggggctcagggaagggactgagctcgggtgtttggaaagggaaagtaggcgggagacaatcagggttacttcttggaggaggcggcatctgagcagatgggaagaaagggatgggcatttcaggcagaggagtgtgcatggtggctgagtggtctggccagtttggggagttagattgtgagcaggggtgtgtgtttgggcagatggtgtgtagtgggttggggtgggaggctgacctggccctagccagatcttcctgagaacaaagaaagtggcctaactctagggaggaagaaacgcagaccaccttctttaacccagcatcacagtgggcaatgcccttccctttaactcacgggaatcacaactctgaaaattgtcttatgcctattttgcagatgcctaattccccagtgcttttttttctagcatctcctccggaaaatctttatggaaggagtttcagggtggggagtcattgctggaaggtgagggtgacggtgaaggggttaagctgtagttctgggcaatgagagtgggaaaacgtccacactccatagggagggatggagggaggggtctggaacacgctgttccctctttccctataggtccaagcctgaactcatggggtcaggaggacccatgatcctgtggtgaacataccctgcctggtatgacttctatgggcctgggcacgaggcttcccaaccctggcagccctgctccgcaagccctgctctgtgctgccacctccagggatccggctttgattccctgcattatgacctgggctggtcgtaatgagactggagttatgggtgaggaggaggtgcagctccaaagccttcatttcctggagcgtatggcttccctgcgtgccccatgggaactgttcccccaactccaacaagcagctccagggcccatcacagccctgcagggatgcagaggaggggagaggctgaagggagagagaatttggagggaggctgctgtcacttctggagagggctgtggaggtcgatggagtggcatgtcaaggggagatctgccagtgttcacgggcaccaagctgttgctctccttccctcctttcctttatttctttgtttctaacacctttgacaaggatgggaggcaagagatccattcattcagtcaccaaacatgagggtctgctacaagcagggagacagaacagcgttttatcctttcactcattcatttattgaacatacgttaacaatcgctttctgtttaagacagcaagatgcaatcagttattcagcgatctatcagcaaagagatgcatttcttcttgttattccttcactctttccacaaatgtttaccagcacctctcttatgccagtccatgtgctgggcactggggacatagcaataaaaaaatgaagtactggccgagtgaggtggcttgtgcctgtaatcccagcattttgggaggccgaggcaggtggatcactttaggtcaggagttcgagaccagccaggtaaacatagtgaaaccccatctctactaaaaatacaaaaattagccaggcatggtggtgggtgcctgtaatcccagctactcaggaggctcagacaggaaaatcacttgaacctgggaggtggaggttgtagtgagccaagaccatgccactgccctctagcctgggtgacaaagtgaaattccatctcaaaaaaaaaaaaaaaaaaaaaattgaagtcctggccctcatggaactgactttctggtgggggacacagataatagaggaattaatctacagtataatttcagggagtggtaaacattgagaagaaaagtaaagaaggacgaagtggagggagaatgatggaaggaatggagtgagtgcgttgttaaagatatggtatcagggagggagggcctctcagaggaggtggcattgggctgagtctggaaggatgagaaggagctgtgcacaaaatagttccacacagagggaacagcatgcaaaggtccagaggttggaatgagctgagatggcatttgcagctaaagtgcaggatgcatctggacatgtggaatttggggtgttggggaggagaaggcacgcttgttgtagaagggctgtccaaggcaaaggcctggagtcagatcccaactttatatatttttaaaattttatttatttatttttgagacggaatttctttctgtcacccaggctggagtgcagtggcgtgatttcggctccctgcaacctccgcctccccggctcaagcagttctcctgcctcagcctccaaagtagctgggattacaggtgcatgtcaccacacctggctaattttttaatttttagtacagatggggtttcacaggctgttcttgaactcctgacctcaggtgatccacccacctcggcctcccaaagtgctgggattacagatgtgagccaccgtgcctggccaagatccccactttacagagggggaaagtagagcccaggaggactctaccaagcatacatcatgacaaagcagtgcctcaaacgtgggacttggactcctcaggcataaggcatctttggggaatgggaaaaaatgcacctctaggtgaatgcaacccagtgtcggagtcacaactggcagggcaagcctgccccgccttgtgagggcacaatctgtactactgtttgagggtggagccctggccctcccatcctcacctctccctccccttcctggcccttcatacctcagcctacaggtcctccctcaggcatcttggctaggtgccctggcagcctgccaactcttcactgctctgcacagccctgctagggctgccacagacatgtcggcctcctccctcccttcctcccttcttccttttcctgctccagctgcttttcctgaatggatggtgactacagaaccctgtcctggcattcaaaattggtccagggaggcagctgtggagtcctgcagctgcattcagctctcctgggaccgcctcccatgagacctggggcacgttggtggccttccctggtcctcaggtctcagcctactgcacagagctgtttaatcccaaatgggattaaaaactgagcccaggcctggctcaataaatgttggctctgccctgtccacacttcagcctcacctcctataatctgtccgtctgcccatgggcctacatatatgcctatggcttctgtgtgcgtgcgaacatgtgtctgcagtcacatatgtgactgagtgtgcatgacgatctgatatgcattccttcatttcacaaatatttatgagtttccactctgtgttgttctaggcacagcaaaaagaaacaggtagagtccttgccaggtgggggcacagacaataaacaaataacgtgtcagacaatggcaagtgcagtggagagagcaaagcagagtaaggggcaggaagttctggggatggcgggatttgctgtttatccatctatcatcgttattacaaatactcatttaaacagggtagccagggaaggccttgtcattaagatgagatttaaacagagatctgaagtgagggacagaggggttgtgcacaaagctgggagaagagggtttcaagctgaggcaacagcaggtgcaaagtccctgaggtcagcagcatgtgtctagtgggaaggaggaacatcgggggtctcgtgttgctgaagtggagtgagtgcaggggaagcagcagcagatgaggtcagagagtgtgggggtggagtcagagcctacaggctctcttgggatttttctgtgagtgagatgagacccctaagagggtttgagcagaagagtgacatgatctgacttatgttttaaaagatcattccgggctgggtgcagtggttcatgcctgtaatctcagcagtttgggaggctgaggcaggaagattccttgaggccaggggttcaagagcagcctgggcaacatatcaagatcctgtctctacaaaaaactatttaaaaaaattagccaggaatggtggcatgtgcctgtagtcccagctacttgggagactgaggcagaaggattgcttgagcccaggacttcaaggctgcagtgagctatgatcacaccattaacactccagtctaggtgacagagtgagaccctgtctctaaaagaaaaaaaaaaaaaggccaggcatggtggctcatacctgtaatcctagcactttgggaggctgaggcagctggatcatttgagcccaggagttcaagaccagcctggggaacatggcaaaaccctgtctctacaaaaaaatagaaaaattagctgggtgtgctggcatgtgcctgtagtcccagctactcaggagtctgaggtggaaaaggatcacctgagcttggggaggtcgaggctgcaatgagacatgatcacaccagcctgggtgacagtgaggccttgtctcaagaaaaaaaaaaaaaatcatgctggctattgtgttaagatagtcagaagctggggttgggaggagcctatggcaatatttcaataattcggcagaggactagtcaggggctttgatcaagggggagcagcggagatgctgaaaagtgaggctgggccacagaatatgttgatgggtcagaaatggggttcaagggaagacagcaactgagtgtgaccatgccctcagcctgggcagcggcaatgatggcgtttcctttcattcagagctgaagacggcaggaagagcagatttggggggtgatcaggaactgaccttgatgtgttacaatcagtttttggacaggttaaaccccgaaagcctgttaggcataaagcagagatacggagcaggctcctgtacctatggctaggagttcaggggtgaggtcctgctgcaggtagcaatttgggaatttgagtggcatgtaaagctgagactgggtgagagcaccagggagtgactgttgatggagaagagatctggggactaaatgctgggggaccacagctacagtgatccaggagatgaggaggaaacagcaagagactgacagagagaaggggaggaaaagggagatatcctgggagccaacagaagaaagtgctgtagggagggagtggtgaactgtgccgaatgctgccattgaggggtaagtgtctgtccaactttgcctgggacagctccacggcataactgttaataatgttcccccagtttggatgataaatcatgtgatcctactgataggtcagatgtggactttgacttgaccattggagttagtggggcggaggtcattagtgaccttgctggcagtgacttggtggagtagtgggtgcacacacatgactggaacaggttcaagagaactgggaggagggaaggtggggacatgtgtgggtgggcgatggtccctcttgggatttgtgaaggttcatttgcctgttgcccccaccccccaaccgcatcccagtagagatggctcaagactgaggctcaggacacaaatcagcatccacacaatgccaccagggcagcttcagctgtgtggggagggccagaagagcctccttctccctgcaccccctcctctactcttcccatctctcctgccgcagggcccggccagactcatccccatgtgcccagactgtgacggagccaacaccatttgcctgggacccctgtgggccctaagccccctagcaggacaggtgagtctctgtccttgcccaggctcctgtgacctggcagatccttgctgctcctgcctagggctgggtttctctagtgggtatgggaagaggagagcagccccaaccctgggtgtgccccctgcctcccagctccccagcagcctcgggaagagtcccatagctccagtttctggcagtcaccgagcacctgctgtgctctgggtcctgttgaggctctgtcactctgtgggacacacacaggaggcaggcacgatgtgagaaatattcacaacttgaggcagcatagacaccaaccacactgactgcagggtcccaggggccaagaagaggggaggtccaggagatccctgtggtaggggctagggtgacagggttgggtggtcttcagggggtttgggacagcggctatttaccaatagcgatgaagcatttccatacacattacagccacactacgtgtacttgactcttctctgccttggaaataggccagatgtggtccctgttcttaaggcagtcacagcctagggtagagacatccattccttaattcattccacaaactcttacagaacattccctaatgagccagacagaccgttaggtactcttgagatgatggaaacctaaagacataattctcccaaagagctcaccatctagagggtggcaacagccattcagcatttacagtgcacctcacatgtaccattttctcatttatccattcaatgaacacttattgaactactaggtaccaagttctgtgctgggtccctggcaagtttcacaaataagccttaacaggtttgtggccaaattaccagattctaatgagagaaatccctggcagttgctcatttatcagtgaaccaaaatctagtgaagacctactatgtgccacaccacctgtaagtgctctgcaaattaaatgcacatgctcgcagatgagcaggagagaccaatattttttaaacccaaacaaaaaaatcccacaacaaaaaataaaacctggaaaatggaaagtgtaggaaactcatgcaagatgtgaaggctcagaggaagagctcctatctccttgagtaaccatggagggctgcctggaggaggggggcattggagctgatccttgaaaggtgaggaggatttgaacacagggagatgaagtaggaaattactggaagaacaagcatgagcagaggaaacctaggacatgaatgggatacagtgaatagtgtagtctggctgggttttatggtgtataaaaagagtgatggttggcaccaaagttatcaaaagaaaaaagaacaaaaatgaaatgagaaaaaaaagagttatgggaaatacaaaggacatggctggctgcaaacagccaattcatcccccatccttctttcttgtttctatttcatttcaacatttgccttcagcttggccatgtgctcagcccctcctctgttaatagtgactagtctaaaccaataggagccagactcctctccctaccagtaattgatttagaaagtattatgtgacacaattctggtcagtgaaatataaaaatatatcttctgtgagcttctgggaaatttttattattcttaaaaaagagatgccttaaggaggacctttttgttttctgcatgtggaaataggtgatggctggtacaatagcagccacttttggttgatgaagggaacaacaccaagaggccaaagaggcctactaagaaaagacagaacaatctgtgtccttggagatgttgtggaactactgaattaagccactctaggtcttgaatccacttccagcctctacttcctccagactctctttctcttttctctgaactccctcaggcctgtctggctgggtctccctttggggtttgctgtcagctgcatggcaaacttccgaaggacaaagacctcacctactccttcttccatccctttccccgttcccacacacatacctggcagagctaagtacagaactggggcctgggagggactcaggagaggcttgctccagacagacttcagaggctggttgggtaatatgaccttccctctcactggggagttgccagctgtgggcatcactgctgctgcttgcacttccggagtctggctggatggccagcatgtcctttcttgatttctcaatgctctggcaacatcactgccaaggctgtatgactgccagcttggtggctccaggctctcccttgtcatctggctttcccctgtcatctggctttccgcctatggacaggggaaggtattcttatcctacctgtcatgggatttctgtcctctcactctgccaagaccaagaagtggggctgcacagagcgacccccagacagaacaaagtagaacagattttgtggagctgcctggggcttctgcacccctgcctcctcccccaaattcctgataatccttttaacattcaggggacctaagaccatgagatccaaagtcagaccagagtttgagttccagttccattattttactgtatgtatgaccttggtaatttgcttcctttctctgagcctcagttttctcatctgaaaaatggggataatagtatttacctcccagggccaacataaggtgtaaatgagatgaggcatgtgaaggaatctgtggtgtttggcaacaaatgttagtgaatgtcatcagaatgactagtgttgttattattatttctggtccctggacaaatactactggaccctattatgcacaaagtatcctggccaggcgaggagagtttagagatcttcatccactcagccatttatttattcagtcatgtatttatttaacaactgtgctaatcaggcctatagtgcagcctgagtcaagaagagtgaagagttgcacagggtatgggagttgcctcctgctccagcgccagactcaggctaggggaaagggtagttcaggaagaggcagctcattcatctgttcattcctttactcactcacttctcccggcacacctggcttgtatgtgtcctctctccatgcttgcctggcttccagggctgccagtgggagcggtgcctgacagtctggctcctgtctgcccccactgagtcccagcggcactgtgcctgctggatcctgagcccagagctctctgtgcttggctgccatcttctccctgggggaaaattatttctaccagctcagtgctctccttttgggccagaatagctcccggtgtaatgcaggagctattgaggcatggaggggtgctgggaagagccactttgtctctgctcacctctcattgcctcctacccctaggtataaggcacgatggagccacaaatgaaggaggcaaccagttactgccttagcgtgcctgcaactcacatgagcatgtgtgtggctgaacacatgcatgcatgtgcatcactgatgtgtgcaggggtggcatacacacgcaccacatcccggcaccaaggacagctccctacacatactaggtgctcaataagtgtggagcgagagactaaatgggtgtctactcttcgtgtgctgagcccaagggctgtttctggggcctgggagtgatgcacgtgtagtgttgggacagagggtgtttgcatctctgagtgtatttgtgtgtgtgtgtgttgagggggtggggggtggtggagtgggggcaggatatgccaaagcttctgggcttggtagctgaacatcacccaggaaggcaaaggtggaaggtcaggggagaggggatgatcagagctggggtcttatgtaccccatatacacagtcacctcatctgcaaaggctgacctggggcccccagtcttgccccccgccccaggctatatgtcgaacatgctgccgcacaggtcttcatgaagcctggctcagtctggatggttttcctgttccaaaccttccttgctccctttcccctttaagataaagcccagactcaggcctagcgttcattcattactgtttagagtaacaaaaggtttttcatgctcaataactccacacacagccttttgaggtgaatactgttatttgcctccatttttcagataaggaaactgagacacaaagagtttatgtgatgggcccaaggtcacacaactgatatgttgtggagtctggatttgaactctgatctgccagctccaaagcctgcacctttagccactacccacgtggcccactcaacgccctgcctgattgggacctgcctactctccatcttgccactgcctcttttcttcctgggcagatggaaccacctgctgttaatgacattcatgcctctgggcctttgctcctgctcttgcctctgccaacaatgcccttctcccttgctgtcccacgtccagctctgactcaatgttcagcgcccagccccactgccctttcctccatgtggtctctcagcctcctcccctgaccctggagagctcacacttatctgagcctgtgtctcagaaccaagctcttctttgtcctggcctcagcattctgcccactggctgtgggtgcttcattcttgctctctgtccttcagctcacacttcagtgctgtgatcagagtttgcactactgaatgtgtgagtgaatccatgaagggatatgtggatggatggatgaatggatgaacggaaggacacatgatggggttgcctggttactgctgtaccccatccctcagactgctcttctatgcttgttccacttatggattcatcaaatatttattgagcacctactatgtgccaggctaagtatgcagcagttagaaagtcagacaaagtccctgtccccatggccttccattctgtgtgtgtgtgtgtgtgtgtgcgtgtgtgtgcatgtgtgtgtgtgaagcaggggagatacatttactcatccaacaacctcacaaataaatgcacaattaccaactgtgccaaggtctgcaaagagaaagtacaaggagcccccacatttataggggacactacctcattagggatgggtggggcaagttagggaacagttccctgagaaggggttttttagctgaaacccaaaggatgagtgagatgtactgaggcacaggtggcagaatgtgcagagccatatttaggggaccgaaaggccaggggaagagcagagtgtgaggggagaagctagggaaacagctgaggacgggcctggaggagttgagattttgactcaaccagaaggcactgaagagcttttggcggaggagatgtgttcaaggttgtgtcttaaaagaggtcactgtgcttgttgctggaagaacaactgtggatgtacaaggctggaactggggacccgtgagaaggtggtggcagcatctgaggaagagggtggtggtggctcggaccagggaggctggcgtgggatggagaaaaggtaacagatttggaatatttaggaagcaaaatggatcagagttggtgatgaatcagatgtagcggacgagggagggagagacatcaagagtgactccccggattttatttttgttttagctgacgttttttgatcacctactaagagccaggcactgttctagcactttatgtgcattagcttatttattcctcacaataaccccataaagtaagttatcattatccccttcacaatctcacttcactccaatgagaaggctaggcaaagggacacagtggaatgtgtcccaagctttgttcctttggggaacaaccttggcagatcacaggcacagggaaggaagaaagagaggccagttgcataccttgagctgattctgagtcagtgagaataatgatagataacatttatagcgcttttactatgtgccaggcatggtgccatccaattagctaataataagaggtaacactgagttccatgcagggcactttatatcaatgatctgattgaatcctcacaatagctgtctttaaaatttctattacagaatcaggaacagtggctcagagaggttgagggacttgcccaaggtcacacagctagttagtggaggatctggaattcaaacaggctctggcagtgggagggaaatgaggatgggccgggaggtgctcagtggctgctggaaaggacaggcctgcgtttggctctcagcatgaaccatgtccttcccccacgctacttgacgtgacttaacccaggcctgagtccctccttaaggcctgacctcccgtgcaaattatgaacatgtatgagtatgcacacacacacacacaccatgcacacacacacaccgtgcacacacacacaccgtgcgcacacacacacaccgtgcgcgcacacacaccgtgcgcacacacacataccgtgtacacatgcagactccttggctagcactgctcacctgcccaggggcaacctgttagaaccctccacctcaggtgcccctggcctgcacctgtctccctgccctgcccccaccctgcccgtgtgccggtgccaccggcagagccgtgctgtacatcatgttgacagtagaaattacatcccgagctgctgttttacaccgcgccctgtcagaactcactgcagcccagtgatcaggacaaattgaataccatcctggccgtgtcaatatttattccattttacaaacgcgtccggatgggggcagggccctgccatggtgccagccaagcagagtcccaggaggcccttctccctccaaaccgcctcctccttgctcttttcccctcttcctcctcctctttctctacttttcataattaattaaaattgtacaattcagccttgataatgaaagctgcacaaatcatacatgcatagtttaacgaaaagtcataaaatgaacccatgaatccacactttgagcaaaatactgaaaatagccccctcctcagaagctcctactgtgtgtcccattcttgaacataacccattggttccttctgtcctggcttttatgactagttccttgcatttccttattgtttgtctcccaactatgcatttctgaccatcttagtttagtcttgcttgtttttgagcttgtatatcatactgaatggtcttttgcatcttgcttctttttctcagcattatgtttgtgagattcgtctttgttcttgcatgtgttccttttcactgctgcatagtactccattgcatgaatataccgtgacttagaaatccattcatccattctcctttttcttcttctttccccttttctcccacttttccttcccttccaccttcttctcttcttcttcctacttctcttcctgttccacctcctggttgcctgccccctgttgttctattgttttgtctgctacatctgggagctgtgcacacattcacacagatacacacacacacacacacacacacacattgatcccagctcctccatcctactgaactactgggggcccagatgccccctctgggtctctctctctctctctccctacccagattttgggtatgtggctccagccagagggaggctctctgtggacctgagtctattaaagtttatctgttttagaggattcctggggcagagactgggggaatggtacagcagggtcctttgtcctcacacatcctgtctctactgtagcagccttggggagaaggcctctcttcccactctcacctactctgggctggggtgggaactgaggtggccccaggtggccttatggctgtccgtaggatgcacagctgtgcagggagagaggactgggacctgggtcattcaggggccaagcctcagcctcagctctgctcattgaaggtcttgtggagcacccgtcctgtgcctagcattgtgtctcaccaaggcagagaaggacctgcaggctggtgtgtgtctggggcctcctaggagccattacagagcaggtttggagaccccaggagcatgtgtgacacatttcattccagtctcccttagccccttctctgtcttggagctgctttgatgatgcacatattcgggatagttaatttttattgtaacctgagcagatgacattaaagaatctgtccctttgtggtacgggagaaagctctctaggctggacggcaagtggagtaggttggagcttggctttgatcccataacactgggtgaccttgggcaagtccctgccctggacttctatacaatggaaggtcaaactgcagttctcagggctcatcagaggacagggtcatgccggtgtatagcaaggtgaggcttgttcaaaatctcattgccaggcctctggagccccagattcagtaaggatgataatagtactaacaggaaggtctatagggtgcttttttttttttttgcctttttccacatgttctaatagggtgctttctatgtgccagagactgtgcctttgatgagcaaaaagaagaggctgtactttttgaccactctgctaagcacactccataggttatcttgcttcatctgtgccacatctgttttattataattgttatattacagataaagaaactggagcaccgagaggtgaagtcacttgtccaagattacagccaggaagtgggagaagccaggacttgaactaggaaagtctggtgccagagcctgtcctcagtctgggatagcttctagcagattctgatgttggcctgagagcctctggagcaggtggtccacaagttgtggaacagagatcaagcatggtacactaactgtgtgcccagccccgagccaactgctacatgttttcacagtgattcaacaaggtatgtgtgaagggctcattcccacacacaaccagtgtgagctcttattgctcttattttaggcaattgtcacaccatcctcctgagatgggctttagtctctccagttaccaatgaacaaagaaaagtgtcaagaagagaggtggcttgctgagaaccacatggctaggggccaactccaaagcagtgagcttccgccccagcatactctgcttccattccctgactcagctctgcagctgaatggcgtctcccaactctcccaacctcagtctttccatctgtgaaatggaggagttggactattgggctgggagcccctgacaccatgtgtgaccttgcatgattttcttcccttcctgcacctcagtctttccatctgtaaaagaagttgccagtatcctactccaatgctacttataaacgctgctttaaaacaaaactcctggtgagggaaggccctaagtccagctccctggaaacaggccttgagccagagctttgcctgcgggaggttcactgggggagagttctcaggaacaccgtggcaggggtgagggaagcaggaccacgtggagggagaagttgaactgtgaagctctctcagcaggggcctcagctgctcccacagggaactctggagctgggatgctccaaatcgagcaaggggccaggcctttgaatccatgtatctaccagatattggacatgggtttctgtcccctcacccgcctaaaggcatgacgtggggtgaggcagctgactttggctgagggctgtcagcagctacagggtcaaaaccgtcctgggtggtatgatccatcacataaaacctgctaaaaactcgggccgacctcagccctggaaacaatagcaggcaagacgtggcctgagcctgggcttatccagctgggcctggccccgctccgagggtctgtcgcttgctgtgatcacagcaggatcagtgccccagatcttgcttaaagcctggcggccaccgcctgcctcgcagctcatctcccgcagctccccgaggtcccagcgattatgccactgaaaattccgctttcatcttgtcaacctcgcagtaaattacaggcctggggaggcgtgggcctcctccttaaacaagattcaattccacttagctgcccccattcccaccccacacacgggttccctccctcccaccaccccgggctcgggatttatggcctctctttgcaggcagctggtaaccatggcaagctccttagggaggcttcaggctggagcctccttagccccagactccagcacggccggccgctttctcctaggatgggagaggggagaggccagagatggcaggaatgggcttcaggggccaaggccgagaggtcatagtaaccccagcaatcatgagaacttcaacactaccacatctgaccctcacaataaccatcatttcccccattatatagatgggcaaactggggccagggagcatgaggtcactgccaaggtcacaaccaaggaagcagttgactctggggctgaggtgtttaagcactctggcatactccttctttccccagctgctgcttttggatgttcaaatctctcttagatctcagcccctgcttacattcccctagtgatggggaaatcactcctctctggcaggcctgttatctctctaacgattagacatagttgccaaataattgatcaggccctgtgacccctcagaagggttattttgacactgactgccctctgtgatctggctgctaactctcttctgcaaactgatctttcatggtttgccaccacagcaggctgcctggggtctccttgctgctcagtgtcccgctctgccccaggtctttcttattcattcccatcctgctccaattaccagccctgtctccattcctatcacagaatatcaaagctggaaatccatgactcctcattttcctgatggagagaggcccagagaggggatgcacttctctagtgcacagggtgaattgacagtgtgggtcccaaatcttccgccaataaaataataaatagtactgagcatagctaacttttgtcaagtgcttgataaccaccattctaagcattcacgaatgtaatccatttacttctcacataaccctatgaggcagatcctatttctattgccatgttgccatggagacaaagtgcagagaagtgacttgtccaagatcacacaggcagtctgacgtcagagccatgctccgaaccaggggctccccacaccgtgcaccctctctccattccacgtggcccgttgtgggtggttgagcagacagaggatgccaagaggagccagcctgccagggacaagtaagggcacctgctctgccagggaaactggcctgttgctttcattcttgggctgggggcctgaggtcagcattctccctgccccaagcctaccccctgcggatttccccatccacctcctcagggacttccagccttgtgacttcttcctactggactgcaaccctggacctctggaggcaggggctgaggtctgattcatctccaaaccccagagcctcacccaggaaccagtatgtagtaggtgctcaaaaaagacttgtttttatccaagggagtcaggtaggcttgctgcagcaggagacatttgaactgatccttgaaggataagtaggggttcgccatatagagcaaaggggaaaggaattccaggcagagggaagaagctgagcaaagtcttggaggaagggctattcagagagcctaggggaagaaagtagaaagggaaggcatagccagcccgagcaccttgctacagggctgggtcttaacttggagataggagcactcattctgacctgatggtgctgggaacagatggggaaggagagagggagagaatatttctcacaggtcctacatccccaggtagggcctgctggggctgcaggctgcagtgcagtttggccaaatcactcaccccagactgtgagcagggccccatctggggtgacagataggcagcactgagccaggcctgagggggcttttactttatcccctctcctgacaagcgatagagctggcagataaggcatcttcttccttaatctccggtctcgggctggaacaagaaaggggggcgagactggcaccttgttcaagcctgaatcctcttcttcctgagtttaaagctatggattctagtcatggattcttcatgggaatcctttctccaggaggcactgcaggtgttgaaggaaatggagttcccatacagggttatactccaggggctctgtgcaggggtggtgagaccctaagtctgtgttcatctttaccccatggatggaacagtctggaactccaaggagaagtccaggctgggagatataaatctgcaattcatcatgtagatgatatttaatgctgatgatatttaaggcaggagctgggttgacttggcagtggaacctgggctggacttccagctttgttgctaccaaatgtgtgacctcaggcaggccacctcatctctctgagcctcagtgccctgttctgtgaaacagggaacaggaatcccaggttcgttgtgaagcttgaatagttgatgaatataaaagtaatcctctggaaagagtcaagtgctgtaaccaagtgaggtttgattattattccccacaggcaagagtggagcagtcatgagagtggaagataatgaatagcagctgctgtttgtggaggctgtaccacctgctgggaccaccctgggctgagcccattgtaaacatccatttatcaaagccccatcacagccctccaaggtaggcactgttattatcccattttatagatgaggaaacacatccatgtccatcctctattcttcctctttgcaacagaggaaatggccctcctcttttctgagcctatgcacaccttcctggaatctgagaaagcttatactatggattctcccttctcctgccttattaccttcagccctctctaagaggtttgtaggcatcagcatttaaacgtgctcaagtagattccatctttaaaaaacaaaaccaagcacatacctccctatactccccaaccccttcccttaatagcaaaacctctcagaaaactgcctgatcatactcactatctcctttactcacctcctactcttctcagcccactgccatctggcttctactcccaacatgcaccgagatggcttactaaggtcaccttgactgccatgttgctaaatcaaatggatgttctccagtctctattttacttggctctcagcagcatttagaatataaaactaaagaactgtgttccctactacctctctaataatgccttctgtaaatcctttgcaggtgtgtccttctctaacccacctgcagactcctcactctttccctgggcaatctcatccatgctgatggtttccattaccatcaatactataatgactcccaagcttagtatcctcagtcctaacctctcctctgaagcccaaggataaacatagagctgctctctcatgcctccacttagatgcctccaaaaaacttcaaactcaacatattcctcttccctaaaactgactcttctctggggttttccatcttcgtgaatgacaccctcatctgtcaagtgttccaggccagaaggctggaagtcatgcttggcatctctcatccctgcacccccaatgggcaatctattaagtctggtccactttaccttctaaataactctctaaattgaccacttcacatcatttccatctccattctaattccgtccagaagtttaagatgactcttaggtttttggtttaacactggatggtggtgtgatacttactacgatggagcaaatttggggaggaagagttggggaggcagcaagagttcctttttggatgtgttatgtttgagatgttcctgagacgtgcatgttgagatgtgtcacagacagtggatgaaacagtctggaactccaaggagaaatccaggctggagatataaatctgtaattcatcagcaagtagatgatatttaatgctgaggaaatgaatgagatcacctggagagagatagagaacaggtccagaagtgagccctggggcacaccaccatcagagatgaaataggggaggagaaggaagcacgatgactgagaagaagctgccagtgaggttggaggccatccaagagactgtcatggaaaccaagagcagaactagaggtcagcatgaggaaagctgttgagaagcaaagtaaactgaggacacagaaatgcctccactagcagagattgttagtatccttgctaagagtgttgatgtctgtcttccctgctgggctgtaagtcccatgaaacaagggatgtcatttgtttgctcacattgtactgccagtgcttagctcattatgcattgttttctggtgtgtctggttatctttgactgcatgttggccattgtacttgaattttattttaaggaataatttaaagcccaggataaaggtatttttttctagtgagcatctgcatatggctgtgggtgttaccattctgtgattaaataaaattaaaggtttgaggttccctggcatacccaagttgtgtggatgaggcttccaatccatgatttaaggctgggtcatctctggttcacccttaccccaagggtgaatcctttggagttccagtttattttggtgagaatctctcacctgattttccaccttgttcaggccatgaacttggatttcaattccccttatgccgtgagatcatcagaaaacaaattcagattttcaaggatcagcaaatgccctctggacaaaagtagtttctatgctctctaagttctctgggcttctgtttttccttcagttttgacctaataattcctggtaattccttacaaagagcttacttgtcagctctgtgatgctttaataagataccttttatattttatttagcattcttagccctttttagctgaagagttggccccaaaaacctagtctcctgtttctaaacacagaaatggctaatccctaggactttagcacagtgcatggcacatcgttatggctcaataaatatttgttgattaaatgaatgaaggaaacccaggtgtccaatgtccctactctttctgatgcatcaaacatcacactcacaggccaagatgctaacagagcgctgtgctcagagctcggtgagctgtccggagaggcagggctgtgagctcagaggagggaaagacccatgtagaatggggagcgacaatggcagggggtatcagataggtgagtgcaaggatggaactgcatcttggcagatgagccaccgggttgtgaaaggactcacaggaagtggacattgtagtaaaggcctgaactcaaggctggaatgtgtgaggaatccaagagctaggagtgggcagagaagcagggaccagccagggaaaggggccaaggaaggccccagggcccagtgtgaatgcagaagccaagttgggctgggacagttccctgcagccactgggaggagggaagagcagggagagaggaggcaacagcttttgttgaaatgcacacatggtaattgctacagaagagtatttcccttagtttaaaacgctttctcctctgcattttccttggtcctagtttcaaaggaattttaattgcaaagaaaattttgtcatctcccttgggggagaggactctgcagcttcgaacagtcatgcctgatgctgattcttctttaaactgggaattttcatgctttggctgcgtggaagctttctggggattgggcagcatggagggaggggtagggatatgacagggctctctgctcctttctggggctgggaaggctgggtttgcagccagggtttccctggcctaggtcctcaacaagggtctttggtgccaacctggacaccacgtgcccaagttatggatgatggttctaatgcctttctccttaaactcagtggatttatttaattaatgatattaatgaaacaattgggcccttagcttccatccttgttccactgtagattattctccacatggcagtcatttggaaaacagtttggtagtttctttaaaagttaaatgtaaatgtactatacgatccagcagtttcattcctaggtgtctacacaagagaaatgaaaacatatgtccacataaaagctcatacgaaaatgttcatagcagcatgattcaacatagccaaaaagcagaaacaaccccaaagcctctcaaccagtgaatggataagcaaatgtggtatatccaaaccagaggagtactattaagcaataaaaaggaatgagctgctgatacctgctataacatggctatacctcaaaaacattatgtgcaatgaaatgagccagatgcaaaaaaaaaaaaaccaaaaatcatatattgtatgcctttgcttataggaaatgtcccgaataggcaactctatagagacagaaagcgaaagaaatggttgcctggtgctggcagtagggatggagattgactgcagatgggcacggaggctctttctggggtgaaaggaatgttctgcaactgcgtggtggttgcacaactctgtaatttacgaaaactcattgaattgtgtgcttacaatgggtgaattttagagcatgtaaattatacctcaataaagcttttggaaaaagtggcccccatttctctcagtacaaaagccagtgtttctataaggctctacatgatccgcccctgtggcccctctcaccctgtccgctccccctctccctgttcctctgctccagccctgctggcctgctgagttttcctttcttggcaggcattctcccacctgattgcctttgcagtagctgttcgccaagtctggatgctcctttccccatatctgtgggcctccctcccttgccatctgactatctttgttcaatgaaaagcaacccgaccactccacctaaaatcacagcccctctccaaggctctgccaactcccctttctctattctttactttccatagctcttatcaccttctaacatattatgcgatttacttatttatgatgcttattttttgtcaccctctctcctccatagcacgtacacttcaaggggataggaatctttgttggttcaattcactgatgtatccttagggcatagaatagtacctggcatggaaaggtgctcaacaaatatttgttgagtggttgaattaataagtgattcaacaaacgttgtctgaacaccctctctgtgccaggagctgagccttcagaagcgcattgaatgagcaaatctctcacccttagatgtcttgcattttagtggtagagaccataggtgaaaaaaaaaaaattaagccagtaatagagggaaaccctcttagccccatcagtaagaaatcacgagtgaaagaaactttacaaaaggctgctatgggagcaggatgagggagggtcttcctggagagtgatctactagataagtagaaattggccaggtgggggtgggaagaagaggggttcaggcccagggaacagcacatatgatggcccagaggtcagggagaaagtgtgtcatcctgtttggggaatttattccagctgaaatatgaactgtgatgggggcagaggagagatgctggtgaggtggttgctggtgccaggctgcagaggactttgggcacatccaaatatgtagcagtgagctcagtggggcacccaccaatcagagaagatgctggccacacacagctggaactctctgactgaatctctgcagagcctgaagccaaaggagagaccctggactttagacatgttggtgatccctgaagcgtttaaacaagggagtgacagtgattagattcaccttttaaaggatcacttcggctgtcaagagcagaacagactggaggggccggagttgcttcagggaggctggataggagactgtttagctagtccggctgggagaattgacagtcgtgggcgattgattggatgtaggtggtcagcaaagagagggataaggaaggatcatggacactaataaccatggccagcatttagtaagcagatatttgtgccaggaagggctacccgagcaccttccaggttctatctcctttaatccacacatcagcaactatactgggaggaaggaactgctggcatccccatcttacagatgaggctccacaaacataagtggtgtatccagcatgcaggtagagtctaatgacgacgttggactttcaggggtgactcacaggttgctggctggggttagcagtggagctatctggggagatgggtgtgggcagggccagagaaagtgagacagttttctgttttccagggaagatgccagatccacagagtgtgagcttctccacctaagtggagatgtcaaatggatggtttattttgcgggtctggaatccaaagaagaaatcaaagctggcaagaagtgaatcaggtcttatcaccacaaagaccccacagggtggctgagatggctggctcaaggcagtgtgaagagtaggaaaaggcccaggccgggtgcagtggcctatgcctgtaatcccagaacttttggaggctgaggggagaggattgcttgagcccaggagtttgagaccagcctaggcgacatagcgagaccctgtctctagtgagactccacctctaaagaaaaaaaaaaaaaaggaaaggcccaggacagccccgagatttaaggggtggcacaagtacaaatcaggctgttagaatggtccctttggggtaactaaacataatatcaagacatatatggtggtgtatgaaccaaacgtttttctagaaggcattagaagatagtgttggcagggtttacctctggagagcagcgggccaggttgggagggcgctgtcacagcctcccttgtcctctctgtggacacagcatgggcttatgcaggtggcacacacaccacgtctatttttgcaaaaaatgaataaggcaataactggttggtaagattttaagtcatttttgtttggcttttttctctatcgttctttgttttaactaataaacgttgttaaccaatgaaggggtaggtgggggaagagatggtgaaggtgagtgaaaaggggtggtcagagaggtgggaggaatagcagaagagagtggggtggaggaaatcagaggggggtgagtttggaggagggcccgccccccactggtccagtgctgataagagaccaagggggaggggccccttgaggtgaggatcagggcgtcctcagtgacagcaccaggaaggccacctgtgacctggtgatggttgtaacgaggagggggcgggcaccagattggagtgggctgagcagtgagtgggagagtgaagcgaagacaacttgataagttgggctttgaagggaaggagggagggggcggtagctggagaggaaggcagggccgagggagggctttcttaaaggagagagttgggtgtgctcagtgctaatgagagggggcgaaagtgtagatccaggcagaaggtagggggcaggaggcgttggccgagacaagaggaaggaaggatcctccgtgatgacaggtgacaaggaggaggaggaggaggagaaggaggaggagcgaaagggtgatcaaggggtgggggccccagggagctgggaacagaacccaggcctctccccctgggctcctaggcactccctctgggggaccaccctccagttctacacttctgggggcagtccccagctttgcttctcgtgctggccaccagcccagcctgggcttgcaggcccttcagctggcctcagggcccaggcagcctcttggttctgtgcatctctggtgcattgcatgaccttcagtgagtcctccccacctctgccccaggcctcagtttctccttaaaggttgtttcagctccaggagactagaactccatggttcaatgccccttccagtcctgcctctgccaccccagccaccaatgtctggattaaggaaaactcaggatgggccttctgacctagagatgacctagacagacacctttcatatcatcagaagggacctgccacttggaattttgtggactttttgttttgtttttattattatctattttttttgagacagggtctcactctggcacccaggctggagttcagtggcaaaatcacagctcactgcagccctgacctcccaggctaagcaatcctcccacctcagcctcccaagtaactaggactacaagtgcgtgccaccacacctggctattaaacaaattttggggggatagagatggggtctcactatgttgcccaggctggtcttgaactcctagcctcaagcaatcctctcgccttggcctcccaaagtattgggattacaggtgtgagccattgcactgggccattttgtggatttctggctctgggtccggaatggcccagttagtttttccagagattcttgctctaaatcttcaagagcagcaggaaagaccactgcttgggggagggggcagatttcggctcaggaaggccaagttctggtccagacactgttccaacccagctatgtggctctaagtgaatcctgtgtctctctgggtggacctcagcggtgtctgccgaaaactggagagaatcttggctcccacgtggttttactgcaagggctgaatgagacaatgcgcacacgctctcctacaacattgcaaaagctcggtatattataactattatcataattaataagccccaccctggtccattaacgctgaaaacgcaaaaaactcatgactcaggagtcagtgtgagagaaatatcagcatgtgtagcaggaggtgtgtacacagatggtcacatggcatggctgatgataaggggaaaaggggaaacatcttacgggtccatcgctaagggagtggacaaataaaatggagtgtattcatctgatggaacacagccacttaaatggagtgaaccagagctatatatgacaacattgatagctttcaaaaacgttgttggagagaaaaaagcaaattgcagagtgatacatcagtatgaatccatttacattaaaaataccacaaaacaatgctagttattttctgtgggtacatataatgtatgctaaagtctaaaaatggtctgcagtgatacatactaagctcatcctaggagctggcgctgaggaagtgggaggggaccagattggaggtggtggggaagggacttcagcttcatcgacagtgccctgatttctaagagaatggattcaggtatttcttataaaattaaaattatttttaaaagaaattaaccactttatttaaataatttctgccctgcctatttcactaaattgtttggaggatcaaattatacgtgcagagagaatgtgtaattcattttctagttgacggagcattttttttaacccatgtgaacttactccatcctcccaacaagactttgagggatggattataatttctgtgctattgaggaggaaaccggggcacagagggctgcagtgatttgtcccaggtcacatacgtgtcatggggacgagttgggagtcacacctggggctgtctggttccacaggctgggcctctttttctgctgcttcaagctctggggtaaaaacaacagcccgggtgcggtagctcacacctgtaatcccagcacattgagaggccgaggtgggcatatcacttgagctcaggtgtttgagaccagcctgatcaatatggcaaaaccccatctctactaaaaatacaagaattagctaggtgtggtggtgtgggcctgtagtcccagctactcgggaggctgaggcaggagaatcgcttgaacctgggaggtggaggttgcagtgagctgagatcgcgccaccgcactccagcctgggcgacagagtgaggctctgaggacaataacaacaacaacaacaccttttaaactgcctgctggccgttgttgtcattaggataatgatggtgggggcagagtcctctgagcaccttctcaggggggctggcagtctccaggcagaagtaccacagtcccatctgaaccggccctaaagacctcagcctatggtctgggggctgccttctctcttgagaccctcactcactgttccctgggaggcagtgtagtgctgaggatagaccttggctattggactcagggagacctggatttgaatgtcagttctgtcacatacagtgaccttgagcaatccacttcctcactctgtaagataagacctagtttgcaggttgctgcgggcaaaatgtgtatggtgggcactcagtgaatgttatgtcctgctctctttccctcttccaagagcttctccaactctgagcaggggcctggataattctaggcagtgtctggcttaaccctgaatgctgtgtgagccacagtgtccaacacaaagtaggttctcaggaaagtctgtgatttggcttcaggaagtttgtggggttaaaggaccaatgacaacaggaaaagtcaccacaatctaactggggtagcagacctactcacaagcaaaggtcttcccaatctcaattgatttctggggtcagctcactggggccatcttgaactctacctttagggcagtagggggccattgaaagtttgatcaagggagtgacatgtctaaatagacttctgaaagaacatgttgtctgtgtggagggtggctttggaagggaagcccagcggtagagagactgcctggaggcagggaggccttgaggaggctgtggtgaacagttcaggtgacagatggggccctgagatcccttctaatcctgtgagatgcctgggggactggaggaggccagggaagagtagagtggctggactggattttgaaagatgctaggattttcttggagattgaaaggaaacctgtgatgtatatgaggacgtgttttgtaaatggaaaaaaatcacatacgcctaccctgatactctcttgtccttgtcgacagcttttcttgggcatataacatcctgcctttgtattcagggagcgttgacacgggtctcaaggaaattcccagctcacctgaatcacttggcagaacaagtttttatgtcaactcacaaactgacccatgtaagccctccaacaaacacagagtgcattatttcgaaggtaggtagccaacaaagggaaatggtcagtttttcttttttcttgtttgtcacagacacatctgtcgacccacacctggcattcaggataatatcacagatgcccagaccttcagattcaagggaaaggcaggaatatggacaggatatgagaaaggagtttacagttcatcataaaaatcacagctcctggcttttgaatgcttactatgtgcggagcacacgcattaattcttatatcaatgtctgatgcgggtgctactattacagatgccttttacagatgacagaatgcagagcttagggaatgaaagtatcttaccgaaattcacacagctggcagagcaggagctggatctaaggtccactatgacagctttctcctatcactagacttgaatacgaataccttcctttttgtccccaaagataccgatactgatgagtctgatgatcatgcttcatttattcattgaaaaaataattattgagtgcctgcaccatggttggcaaagagggaagagaatggtggtagaacaggatagacaaagatccagagacagaaatgaatacaacgtgcccaggataccctgagtttggcaggttagattccacagtagatttgcccggggggtgggagcagcactggggagaaaggggtctctacacacagtgggtggagatgcatggggccaagtgccctgagagagcaggaaggagtctcgcttccttatttattacctctgggctctcaaatgcatgactactaggcagaagtgacaaaataaaaagggaaaggaaaaaatgccagctacagccagaataaaatcagggcaaatagaataaaacctgacagccaagtgtaaataaatattcgtaaaagagttaaaggacagattaaaataaaaacaccaaatgcaattcttaccccttgacaaatgcagtgcgaattgggttcttttaatcaaatgtttggcaggtgtatgaattatttataattcaatatcgggtggttaaatggaaaatggaagatgttcccgtcgtcttctcagagcttatccgcctcccccagtgagttctcccccgggggagggaagggtgggtgggtgattgcccctcccccataccaggtgcaggcctggacgctggaacccgtaatccctgcctaattctgggcgtcaccatttgtcaacttgctccctcgtcacaagcctccttgctgctcagagctttgttcaggaaggcgggctcttcaaagctagggacaggagtgggagcagctggccaggtctaggggagcctggagtccagagacccaggttcatggcccagggcttccacagactctgtgcagctctcgcctcttcctggccctcctccactgccatcctttgcttccacatcctttcatttttgtttacagcatgcagtacggcatggggtgccccccacatccagttatggcaagaagcataactgtctccattttacagaggagatgcctggatgtacctctggtcacacaagtggtgcaagctcgagttggggttggaacctatgtcttcagcctccaagtgcactgggaatgcattctgggagcagggggaggtctggagtctgagtagagtggacaggacatgagctccagaattacacagactcagattccgattccagctgcgtgacctgggacacgttccctaacatctctggtcttccactttcccatccgtacactgcagtaatgataggaactgcccccggggctatggtgaggatgaagagggggtggaatcactatgcgatgcctgccctccatggaagctggatattgctgtcattaccgtagttacaagaaatgaccctcattttacagatgagaaaactgaggcctgcagtcacagagacttccccatagtcattcagtgagtcagcggcagggaatccagacctctaggagcttggcagaccatgtgtgtctggctcatgccagcacctccccaggtatccacccacccctgattctgagttggatgtctaccctccccacccccaccgccatcaccaaagagtcccagagagcagcttcacatggagtcccgggcctttctgcacttttctgctccccaatccatttctctgtttctgtctcacacacacacatatgcacacacaccacacgcatacacacaccccgtgagccaaagcaggagcggaggatcccaccacagccaaatgttgcctgacttccctgagcagcagatgaatgagtcctcacagctaacaaacggctgtcggaaaggtgggagaatgaaggtaattagtccccttaatgccgacttcagactaatctttcacacttaaggaaattgttccaatgattttcttattttcaggggagctcgttaagtaagaattagaaaaatagatatggcaggagataagaaaatggattttgtagtgacaagctgcctatacacaccgagagggggctggctggcccgggtctgacgcacagacccagatcttcctggagtgcatgacaggaaggtgtgccagagtccctgggcaggacaaagaccaccagggggacaaaggtgatcagtgaaccctgattgcagttcgtctttgcacccagaccatcgttctcagcctccctgctcctaagccctggctggaagaagcggttcacaactttcctcaacatctggaaagaatgatgtctttgcagggacccactgcagaaaattcagacctcaacaccttctgggatctttgggggaagccaaggaacatttattgaatccctgctgtatgcaagctgctgtgctggctgctttctctccatttcacctgacagccccaggaggtagatgtacagaggtggaggtgcagactcagaggtggggccgatgttcagctagccctgtcagttgttttcaactgtcacctgttctgattgatcagtgagtatgctggtccagtggctcagtatttttaatatttctctttgtcatgtgagccaaggccacagggctgtagattcccatctgaaactggaacccatggtgtctgacaccaaagcacgccatttctgtccctccaggccgcctctgtgtaaggagtcccagtgggaaggaggcatggaggggatgacttggagccaggagaaactgtctcctgccgagatagtgcagctttactaggtgggaaaatgggagggaaagtctgaaaggtgtttgtccttctgggatgggcacagatcatttttccctcactcctcatcagcactcattcctgcctctccatctctgctcaggctttcccccgacccccaacctgaccactgtacccagtgctgatcactcctggtcttcattcatccccaacagccccagacttctctttcgcccctgtacctggtggggactcattggttcccatgtttagctgcattctgggaagcttgcctttgcatgtgccgtgaccatccggtctgtggaccaggttgcagcattgttagcagaactgcctggtgattggctctgccaaaggagaattgttctcgaacaggccaaatgggaaaacgagactttgtgaaaatgtcaacatgacatttttcctgggtcacaggccaagtctcccccactcccccaccacaatgtagacctctgctgtgcagaatttgtgtgtttggagaaagcccctagtgcagtgcttctcaaccaggggggaccttgcgacccttgggacatttgcaacgtctggagacatcttcgcttgtcacaactgagaggctgctactggcatctagtgggtggagggcaggaatgttgctaaacattccaaagtgcccaggacaccttccccccaaacacccatacacaaaataattatcaaacctaagatatcagtagtgctgatgttaagaaactgccctgcggtcatctgatccaacgttccctttaagcaacttacctcagagttggggatagaatccaggtctcctgactgtttctaccactgagattaaatgatggaaagggaattggacctctgaggcaagattcagggttcagacaccttttgttttcaatttgacacatatacattgtgctcctgtgacataccaggcattggacaaggtgctgggtactcagtggtggattaaaatatatacaatctctgcccgtttgggactcccatgtagtggattttgagctgggtgaccttaggcatgtctcttcctcctctgagccttagtttcctaatctctaaaatgggcacgacaggctgtctgtcccagcatttttgtcaggccttcaggaatttaaatgtcaaatacaattgtagattctcgataaacatttaagtggattgaatgcttctccttcctggagagggctggcaggtggtggggagagtttttctacaaggaaaagagaaaggggagaaaactaagacattatggagcacttactgtatgcttttcatgggatcttcctgtcaaccctggaaggcaggtgttctcttactcaaagagaagatgaggaaacgggggctcagagagggaaagggacatgctcaagctggatttgaacccagctgcctggctctttcagctctcccactctgatgctgggcagggagtcgaggtccaaatctgaccacgcctggccctcaagccttattccccagcatcccccggggtctcagtctcaccccattagcgctgctttaaaaagtgcggaccgaccagggcgcgttattgcccacataaatcaggcagctccaagtatggaacacctttaaacaaacagctgatgggagtgaagttccaggatcattattaatagcttttcatttcagtggccgctgtgctgtgacatgccttcccagcagaaaccctgcgcagccagcccccgatccgccgatcccccgagtctaccagtcagaatgaatgactgtacctttgtgttaattgtggagcccagccacatgcagaatgctaatagggctgagtgagagggggtgggtgccagccttgcctggttgctgggcggggaaggaccccacctctggtcttcctccgtggcagccagctgctatatctgtctaacatccttatctgagctctgccctcctctgctctagaaagccctatggctcctgtggcccagacccaattccagactcatctgtctgccattcagggtccttcatgtctcttcctttctgtggctccagcctcctttcttgcattccaataccatggagtcctgtgctgctcaaactcttattcatttattcatccattcaatcaatcatccatttattcaataaacatttactaagccctctgagggatagaggggatgaagctgtgaacaagacgggcatggtccgtcatcccatggaatttaatatcaagcagaaaagacagacgttaggtctgtgtcagtttagctctttatcatctgtgtaaccttgcatgaataacctcttctgggcctcagtttcctcctctgtagaatgggaataataacagtagctacctcacacggtggtgtcaggacttaaatagctaaaaagatatgtgaatcactcaatattcctctgatcatttactatggagtaagaagtactccgtaagtgttagctgttattatcattattaactcacgacttcattaaaacatgcgatgatgactataaaagaaaggtacaaggagagcatctgacagggagctcggactagtctggggctcttgggaaggggtccctgagaaagtgatttgttctcagactggagtgtgggggtggcgagggcgagggcagccaggtggagggaacagcctgggtagaggccctgaggctggatggattttgccaagctgagaacctgaaaggcagcggggaggttggcacgtcaggagcaatggggaagaaggccgagatgagacaggagaagcaggcaggaggccacaccgtgcaggatctcgtgggccttgttaaattttagatttcattctaagagcaatgggaagctattgaaagcttccgaagcagaggattggcatgaatcttattctgtttggaactcacccaggctactgtgggtgtgaagcagactggcccccgccccttcacctgctggggtcccccatcaggtggctgagaatgaaacacggacatgggagaggaggatgttgtccaggtgaacaataatggtggcttgaagtaggtgggggcagtgaggttggagaggagtgggctatttctagagacatacggaaggcagaatcctcgggatatagtaggaatgctacggggagctgcaagatgaggacctgttcggtaagaccttgaggtggccccattcacagatttggggaagagagggaagtagcaagtttggaggataaggaaccatttatgtagcttaacattccccaatgtgtggaggcctgtgagcccttgcatgtactgttccagggagaatgtccttccccaatcttgtctgatgggggattttgtatgaatcactcaaagccaggctccaatatcccctccaatatatgaatccctccctggtaccccagatttggtctctctcccctatgtgtccacacctctcccagcaccctgtacctcatagagctcttggctccttcagtttcctctgctgtttccatctcatttccctccaagttttcgaaggccccagagggtagtccctgggccactcctcctcagatgaccacatgtaaccccgcagcttgaaaccccatggatttgctgatgacacccaaatatgtgtgtccaactcagatgtctgcccaaaacccaacacatagagcctcttgcctgttcagtgcagatatctaaaacgcccttcaaaaccctcatgtctgaacccggactcctgagtcctacccccaaccacacacaaataatgagaacataaattcaaaaactgctcctcttccagcattccccagttcggtaactggcaactccatgcttccagctgcttccgccaaaagccttgaagtcagtcttgacttcacaccccacatccaatccatcagcaaatcttgccagctctaccttaaaatagatccagaatctggccgatcttgccaccttcattgttagcagcctggtccggccaccatcatctctcacctggatgattgcaacagcctcctaactggtatccctgcttctgccctggccccctgcagactgttctcagttatggtgttaaaacataaatcaggccgtaacactccttctctcaaaattcttttggcttcttgtcttactcggagtaaaatggctcataagatccaacaagaattggcttcttgttacttctctgaccttttcctactcccctctccctctatttcagccacactggccctctggctcttctctgaatagaccaggtatgatcccacctttgggcctttgcacttgctggtcctcttgcctggaacaccctcgcccctgatgtctgcctggctcactctctcccttccttcgagggtctgctcaaatggctgaccccatgcacctttcccttacaacctgtgataaactagctcctcagttccccaggccattcatatcccctcatcctgctttcttcaccttctccataacacttatcactatctgatatattataaatggatgcctcctttctctataatgtgagtgccatgattttaggggtgttgtcttttttgcttgatgctgtattcccagcatttagaacagcgcatggcacataataggtgctcagtggatatttcttgaatgactcgcatagtttttatctatctgtcttcctgtttgtctgcttgtctgtctcccccagcagacagcgggaagccactggatccgattctccactgctttcctggtgtccaacacagagtctgcagagtgggtgctcatcaaatgtttgaataaacaaatgaataataatagaatttccagatggattgcctggggcgatatgagggagggattatggctagacagagctgcctactggaaattttcctgccatttctgaaggacctggggtcacctgggaggggaggaagctagaaacatgagccaaggaatctctagaggccagaagggatagagattaaaatttaggagctggtgatggaaggatctggaagtgcaggtttccaacttggcttcatgtttgaggctaacctgtggatttagaattctgttggaagttcaggaaactaaagttttagaacaggccaagagtttagggttagggtctgaattaaggtttggagtttggaaaacaggttgaagctttggatttaaagttaatattcagaattctagttagagctgagtgtttgggagctgggcctaatgtttgtggtcaactggttttgagaatgggtcaagaaatgaaaactttggtgagaaaactgtacaaagttgaaggtggcatcaacttgaggggctcaacttgaggatatttattagattttcaaagcttctttgccaggacactatgagacagaagctcacaatatatagtcaagttcttgaacagtttttctccaccaggggcaattttgccacccaggggacatttagcaatgactagagatgtttctggttgtcacaactgggtgggagggtgctgctggcatctagtgggtagaggccaggaatgctgctaaacattctacaatgcccgggacagccctccacgacaaagaattatccagccccaaatgtcaatagagctgaggttgagaaacccagcactggaggatttattcattctctgaagggttagccaaggctaatccaagtgggccaggagtcaggatatgagtgtttagggggagggctagtgcgatgcgggcctgagctatagagtcaggtgtgggcacccttgtgtccccctcctcctggatggagctgctgacagctaactctggctctggcagactctaagggagaggaagggggttagggtggagatggggagggagaaggaggagagggccagcccaatgtgtcagggaattcacgaagctagagacaagcagggtgggagctggtgaaagagagagagagagtaatagttttgcagagttgcagagagcccaagcagggtctatggggggtgtgtttggaaggaaggctgggggtgtggcatggatagtcagagagctgcagagagagttggcatctggagggcctggtgtccaatgcaccctctgcaacttatgtgactgccttgttcaagacagaattcaaataataacagctggctgggcatggtggctcactcctgtaatcccagcactgtgggaagagaggcaggtggatcacctgaggtcaggagttcgagaccagcctggccaacatggcgaaaccctgtctctactaaaaatacaaaaattagctggatgtggtggcatgtgcctgtaatcccagctactcaggaggctgaggtaggggaatcacttgaacctgggaggcagaggttgcagtgagcagagatcgcgccactgcactccagcctgggagacagagcgagattccatctcaaaaataaataaataaataaataaaacaaaaaacaaacaaaaccaaataataatagctaacacttgcatcgcacttactctgtgtcgctctaaatgctttacatctgttaactcatttttaatcctccattgagcctgtgtgatgggtactaccataatccccgttttacagattggaaatggaggcaaaggggtcaggtaagttgcataagatcccatagccctgagcggccctgctggctccagagctggctccaggcttctgttttccatttgcttcctctgccgtcgacattcatgatctcatcacaccctctcaatagtctcccgagataggtgctcttgttacggcccctgctgcactgatgaagtaaccaaggcacagagaggtgaacgacctctcaacacagccaggtctgcctgacagcaaggccacttctgctcctctgcgttgcagcctggggtgcacctctgcacagccccatgtgcccactcttgtggccatatctgatcttcacaaatggcctcagacttcagggtttctcagcctcagcagcagtgacattttggctggataaccctttgttggtgggggctgtcctgtgcagggtaggatggctggccgtattcttggcctctacccattgaataccagtagcactctttattcccagttgtgacaaccaaaattgtcctctagacaatgccaaatgttccctggaggccaaaatcaactgctctcccaccccaatggagaatgactgctccagacagtaggcaaaggaggatcctcctatgacatagtggatcatggaagaaaggaccagagagggtcacaccttacccaaggtcactcagagagttggtggtaggacttaggtctctccagccaacaggaaggcatgcctgctgagctttcccactggaggctccctcccccagggtgagtgttgagtgccaacgatatggcaggagctggctgcctgtcccaataaatgcaaaggtcccatgagcagcccgtccttttcagagccctctgctctccagctgagctgaggtggggttcgctctgctcctagctgtggcactaggaaaacagctgtggctttgatgtcaaacagaccagatttcaaatcctagctctgccacacccatactgtgggactccaggcacagcactgaacatctctcaccctctgtttccccatctgaaaaatgggcagtttggattagagaatcgcaaacgcccaactaactctgatgttctgattttctgacaaattagggtatccggtgtcttagtcctggctgtgcctgcaactcaaagtggcatcttgggcaagtcactgcccctctccagaacccactctcctcaatctgccattcaccttcaagcagccaacactccagtcacacagaacttctcattgtgatctaaaccgtgaattcttccctgcgttggttcatgctgcccctctgaaatgctctcctgcccattatccacctggagaactattcatctttttaagactgagcccaagtcatttgctccagggggtctttctgattcctgcaggcagagttaatcactccctcttttgttctgttctggtgcttctagaagagcaccagccactggttgtgtgtgtgtgtgtgtgtgtgtgtgtgtgtgtgtatgtgtgtcttccccactagactgaaagagtccttgcagacagatcctgggtcttcctaatcctaatgtttttgtggtccacacagtgcctggcacagagtagatgctcagtatatgttgagtaagtaagaatgaatgaattgggggaggagactgccaagaccccttagtggttacaaccctctagaatccagggaaggaggccaacctcttgctgtcatctggtctgaagactgcccccatccccagtcctagcaatggcctgttgcctcagccacccacacattctgtggactcagagagtaccttggacagcaaccagacactttataaaaaatgcttttatcctccatgaagctgccgctacagggagctgtctgtgctgacctgcatctccgtgtgtgcatggagacatgtgcttgtagaagaggccttgcttcttccatttttcaatccatcccaggcctttctgaggatcaggcagggaacctatgtttttcatgtttatgtttctgaatgtgcagtctccgacccaagataggggtggctgggggtagggggagaactttggaattccctccctctaatagtcgtttgaggaatccactcttcctctgagccacatgtccccaaattgtccacaaccctattccacgaagtcctctgactaaagaaaccagatctcagttcctggttttgggggtggggaggagagaggtggtctgtgttctttgagatccatccattcaacaggtattttctgagaagctataaaaacacagaggccaggtgcggtggctcatgcctgtaatcccagcactttcgaaggccaaggcgggcgtatcacgaggtcaggagtttgagaccagcctggccaacatggtgaaaccccatctctactaaaatacaaaaaattagccagccatggtggctcatgcctgtaatcccagctactcaggaggctgaggcaggagaattgcttgaacctgggaggcggaggttgcagtgagccgagactgcaccactgcactccagcctgggcgacagagcgaggctccatctcaaaacaaaaaaacacttatattatgtttaacttattggagtctcagtttcttcacttgtaaaatgggggtaggggtaggtagatatgcctgcaagaccaaatccttaaaagggggcagctttatggtttatgcattgatcctcagtgcaacacatcagcttcaaccttcacctaaaagcaggactggatgtcctcattcagctgcgtccttcctgtggagccctagttaagccccttcccttccttgagtctctggttgcaaacgaagtgggttctgttctctaagttctggttcagctgtggggtcctgagtttctaggattctataatgatgctgaggagccatgcaacctcctctttcttcctcctgccccaaggaaggggctggggcctcagacaggagatggggacacaccagagcttcccaggggtggtaggagggtgcggaaagaggaagatctgtcctagctggggtgtgagagacaagttaacagctcaattgttatttcaattacacggattatttgaaaacaatgtttatgagtttcatcactgacaaccccgggaaatggctgctatggcaaccagggaaaagaatggccctgaccagccaatcagaagttccaactgtgccccagtttgtacaaactctcccttctccacagggctccccccaacctctgctggggtgggtaggtgggggcttgggagaaagagggaaagaaaggggcaaggaaaaggctactctgtagaagggaagaggacaactgaaaaaactgaggcactaggagaagtgggattcctggcattggctgttcatcccaaattcttcaagggcaagaacatatctgacccactgcaccttcccggtgcccagcacaggcctggcacccggcagacagtaacagggcttgttccagagctgcctgtggctgaggaggggtttcttcttcacacccttcattctctgctcactgtctggagggagagaattctccgagacctcttccacgaagggcacacacaattggccttgtctttcactgccaggaagagaacaggcatgcgaggagcctctcactggcaggtgagatctgtgaggttctggggtgtctctgagagccctggatgtctttccctgctgccctctgcagaggccgcctctccatgcaacgtcctttggcccagacttctccaaatgaggcaccccagtggtctccagaaaaaatgtttttgctttgagaatatcctgtgctctccctattcagaaagaggccaacttgacaggaagctggctggactctagctctgcagaactccctcctgaaagcccatttgctacccagcctgagctctccgctgtccactcctgtgttcccgaatccctcatcacatttacttttaaagaaacccttacatagggcttatgaatgctaggcactgttctaagtactttacaaacattagcttgtttcattctcaccacaagcctgtaacgcagctactgtgattatcatctccactttacagatggggaaactgaggtggttaagtaacttgtgtaaggacaggcagctaggaaggggggcagctcagggagcagaacccaggaagtccagcttccaaaatccaagtccagcttccagaatccaagctctgggctgccatcctcattcctcctgataggtgatgatccagcttaagtcttgcctgatagtcaaaagactcaaaaattcaacttttgttgcctcatctatttatttgtagaggcagggtctcgctctgtcacccaggctggagtgcagtggcatgatcatagctcaccacagcttcaaactccagggctcaagcgatcctcctatctcagcctctgaagtaactgggattacagtcgtgtgctgccactcttggctaattttttaatttttgtagagatgggggtcttgctatgttgcccaggcttgtctgaaactcctggcctcaagtgatcctcctgcctcggcctctcaaagtgctgggatcacaggtgggaaccaccatgccgggcctgttgcctcatctttttatatcaggagcctcccaggtgcttgtcctgaaactcctgggccctctttttgtatcttcgcagtaggggagtggcagacagatataagagaagaggcacctgaggatgttaccaataagtggacgtctgtagatcagtgctggttctcacagcccgaagtcctgatctggctgtaaggcagggaggggcatcttcattaatttggtacccactgtgaggacactatttgctcattatctcgttcattccagcaagggaggtcttacactcctcattttacagatgagtaaacagaggctcagaaagtcaaacacttgcccaaggccatccagctaaaatgtatccaacagggattggtgcccagatctgcctgtctctgactgccattagcaaaagacattattcctgtcctcaatggaccagttagagaggcaagacaggtaacaatggttcgcaaagggctgaaacagggcactgagattgaatagatgtgagggctcagcccaggtgagcaaaggtttgcaggtgggaatgggccctggagcaatggcctagcgggtatgtgtctgagctcatcaggtgaccatgtcagatgatgagttggggctttgaacgccaagcagatggtttggcgctgacaggcaaggccacagggagccactgctgtcttaggagcctctttccctccctcctgaggcagcctccctctcgcacagcagagcaatttcccaaagcattttctctaatttgtgattgtttttctaaccagaagcagcaagagtctccagcttctcccagcccgtaagacgagcctgatggagctgccaaagctgcaggtctccacccccagcccagcccacttggggacttacaagtccctctgtcctaaaagcccacccatggtactaggcaggctgcggggagggtcttatggtcccaaatccaggggcttctttcccagcctgaagctggctgagttgatgcagagacctgggagtgactttaagctggggccacccactgctggctgattgtgccccgcggacatcaagggctggtaccctgggacagagggtggcatgagggctcgaagccaggggctgctcaagggctccaggaggggcaggggctgagtgaggaggtcagggctctgtgagtagggatgcgggctccttgagggaatgcaggctcagagaggagatgagtcttcagttcaggggacagaaattctgtgggagaacaggggctctggaaggggcaggcattccagaaggtgaccaggagctaagtaacaggaggtgctcagggatggaacgggggctcagggatgggatgggtctccaggaagggtggggggctccgtggagggttagagctttcacagggggtgcaggagctctgtggagattctggggaattgggggctctatcttgagagaggaccaggcctccacaaggagatggggactccaagaagagacgggcgctctgtgggaggtggggatctggccaggggctcagctgcagggctggggtttgtgagcacaaaggctcagaaaagagagtgcgggctcagtgaggggatgggggctaacatgctggggacaggggttctgggaggggctcggggctttccaagaggatgagggcttggagagaaatggtggcttatgaagggacagtggcagtgagacagtgggaaggcccttcctccaaggttgttttggggattaaatgcagccatctcctccctgacccactacccaggtgccctacctcagctgacccatcctagccacaggcttgtctccttggcttacacagccctgtgcccctgatggtcccctcaccttcgtcctctgctccaccactccccctacccacctcttctcaaggcaagatcccgacgccccctctactaactcctccacaaatgtcccactctgcacccatttcctcaaagtcacctctatagatgatatccccctacagcccaaatgcattatcagatcggtacttcagacacctgtaatgatcaataaggttgtcctccctcacagccaacctcaatctgtctagctgcaagtgcagccaatttcttctgttctgtcctggaaatagaaaaaaaaaggctcatctacaggccactgttcattccattcttcttcactttggatacataaagtctcctctcaaacttctctcttctaggtaaaatcattctggttcttttccttggcttttctaatcattatctttagtatcaggtatcttcaaatgctgtgttaaggttttatcagagcctggcacatagtaggctcacaagaaatgtatcttggatggatggagaagttggtagattctgagggtgaatgagggtggagagacaggtagtaagaagacggaaagaaaggtggtgatacacgtgtaggtaaataacgggttggtggatagatgggtggaggtgggtgaggggtgaactgcaggcagatggatgtttaaatggaggtgggtgggctggaggatgatggattggataaatggatggattgatgaatgggtggatggatggatggatggatgggtgggtggatggatgagtggatggatggctggcttagatgggatgctggctggatgaataatctcagctggcatctcaattttcccctgcctctcccaagcataggctcccctaatttggttaatggaccccagttctcccagacaccaggcctgagactttgtcatatttcattccaccctctcccttatctcccacaaccaagcagctctgagtcctgttgatcctatttccttggggcctttctccctggcccctgttctctacaacttcattaagcccccaccccacttatctcctggacaatttcagctgtccccgtctgttgcctcctttctctttccttcaagtccatcctaaaacactgtcaacagcaagatctttctacagcttaattccagccagcaaccttcaatagcttcctactgcttacattcctcagcctggagctccacgcatctgaattcagctgcaccttccctttctggtcctctctgtctttcctcccctccatgtcctctgtgccctggtcaacggggcaaccagctgacaccgaagcctttgccaagctcctcctctttgctcatgctctttccacctgcagaaaacacctccacctgcagcagcgtcatcctagcttcaacacacagctcaaatactgcctcccccacgaagcctcccccagtgccttcgaccagacagagtcaagcgcatcacttcctcaagagcatttatggagcacctactatgtgcccagctggctaatagggtcctgatggtgggagggctaggacacaggagagacacaacctttgccttccaaggtacacagcctgctcatgtagtcacgtttgtgtgagcacgcaggtgcgtacaaacatatacagaattcaagggaaaacaataagggcacagtggctcacgcctgtgcgagactccgtctcaaaaaaaaattaaaataataataataataataagggcaaaatagcacagtattagtagctagggctcatagagcactgaatatgggcctaagtgcactgttctaagtgctttacttctaataattcatttcgccttctcaataatcctatgagataggtacagatgaggaaactgaggcagaagttcactcagctagtaagtggcagggcaaagatgggaaccctggtagtctggctcctaggcagttctctcaacagcacacagtagggtcataaatagcgctgttggagtggggtggacagagaaaagtcatgacaaggctcattctgacctcccagccccctcccactctgccaacttaactcccttctcttcaagccatttgaataaatggacactgaaatagactgagctaggggcaaaggattcagtctgctctgagacaccatagggccctgggcaagttccagcctctccctgggcctcagtttcccttctgtatcaaggacttggactcgtcagtccctaaaggccctttcaactccaaaatgcataaccctaaacacagccacttggatcctagaagacgcaggccttggcaacctcctggcctggggggtgggctgcctctcccaggaactctctgttgtccctgaatacacaatttcagcctctggtccctgtgggccccgctgtgaggccacagtcctatgtctggttacctgagtctgtctggcttgtcacctacccatcatcttgtctacccactgacctggatccacctgcttctgcttcccatccatcagcctgcccgggcccatccaccttatgtcccccgcctgcctggtgcctgtcactctgcccatcacacacacaagcgcgcgtgtgcgtgcgcgtgcacacacacatacacacacactccacctccccagctcccctcccctactctgcaagcactacggtgacaacaaagaatatggggcggggctttctgcttttttgactcgcagaggggtctgtggtgttaacatctggaccaactttccagaggccaaaacagttctctgccatccagcatccttcccttccccagggaccccccagtcccctcttcgctggccccaaggggcttctacttgaggaatctggtgagcgccacacgactcctgccaaaaacgtcccagtggtccctgaagaaatcatcggacaagagcgtgaagatgtgtgtacaaggatgttcatggcagaattgtttgtaatagcgaaggactggaaacaacccaaatgtccaacagtgggggctggttaaatgaattatgggcagccacacaatggagaaccatgcagctcttgaaaaatgatgatgtagatgtatatttatcgaaatggcaagacattcacaatatattatagggtgaaaaaaagcaggttacggaggcatatgtataaagcaagatgccatttttattttttaaaaatctatatatgtcaagaaggatatgcactgaaatggtagccaagtggtggtaaaattatggctaattaaaaatgctttcatatataaaaaggtacatacatatatacatatatataaatttacacacacacacatacacacacacacagagagagaatcactctgtattaaatacttcatatgagccccgtgcagtgttaagcgctttgtctgtattacttcatttctccagtccttggaggtaggttttgttacaaccattttctagatgaggaaacagaggctcactcagctattaagtggcagagctggaacttcaactctgctctgtctggctccagagcccatgcacctaatcagtaggttgtcatgtttctcattttctcattttgtttatctgtaacttgcctattaaaaaaatatatatatatatgtatatatatggctgggtgcggtggctcatgcctgtaatcccagcactttgggaggccaaggagggtggaccaccagaggtcaggagctcgagaccagcctggccaacacggtgaaactctgtctctactaaaaatacaaaaattggccgggtgttgtggtgggcacctgtaatcccagctactcgggaggctgagggaggagaattgcttgaacccgggaggcagaagttgcagtgaaccgagattgcgcccttgcactccagcttgggcaacaagagtgaaactccgtctcaaatatatatatagtatatatattatatcgacttgagtgataaagaaacaacagaagttaataagacaacgaaagaatgaggctggtgaactatacatggcaatgtgccctcaacttctgggctcctggacaggaggtccccaccagcgggtgcatccttctctcctctctaagtgcctgtgtattagcatggtccagctctctggggaggggccaggcaaccctggtcagagttgggccttagtcttgcagacttcaaggctgcatggcctcaggccccctctcctcacacccaaatttaattcagtgaatggagtgagtgcagctttgcaccatatgccacgctagaccctagggaggaaaaaatgaaaaagcccagtgcctgccttcaagatcttctcatacagggcttggtttctcagcctccacactatcaacagtttgagctacatgagtctttgcagtggggtgggggggactgtcttgtgcgttgtaggcggtttggcagcatccctggcctctacccatcagatgacagcagcagccttctacgcagtagtgacagccaaaaatgtctcgagacattgccaagagtcctctggggggcaaaattgcccccagttgaaaaacactgatctaatgtgctgcagatgacacaaggcaggcagtgagaaaagaaaactaaactaattgctacagaggttcaaaatatagacaggagtcacgtgtgcctggctgggtccaagaaggcttctggggatgaaccccgtccccgaaccttgagagcgcctcaagattctttccattttacagactcatcctggatggtgagctcctccttcctcatggcctcaaaactctatttccagcccagaactctctgagtgggcctagatgtttttgcatgactatccatccagcatccccactcatgtatcccattaggatctcaccctcgacctgtccacagctggtcctcacctcttcttgaaagcccttctcctcttcatttcgcatcttcacaacccacacagcctcccgagccaggaatgggaactccttctctcccccatgcccaggcagttacttagccctgtccattccactcccacaaccctcacaagtgagtccccctccatgcctcagacccagacaccagcagcccgggacctggtcttccccacccagcagcaggatgaggcttctaatggcgaatctccacgcgccactcccctgctgaaaacctgtgcgtggctccccgctgctctcgggatgaaggccaagctccttgtgtggctttcaagacccacgggacctggctgctgcccacctcgctggcctggtttcccatgactcccactccctgaaccccaacctctgtgtgttctccttcagccaactgaaatctcagttcctctgctattctccctccccttggggccttggtaccccttggcatggaggctgccttctctgctcttattcctccctaccctcctttatcccatagataactgcgagacagcctgcaggtgtgcctcaacagcacttcctcctagaagcctctgctgccccgcccactggctgtcacagttatgagaattgttcatcttcctccctggaccaccagactcctgtcagctgggattcaggctgcttgctcaccattgtgtctccaccatgcagcacaatgcttaacacatagtaatgctttatatgtaaatatatgtaaatgctttatatgtaaatatatatatatacattttaaactggataatgaatgtatggtcagacaggcagatgggtgatgcaaggaagaggtgctatttgggttgggtccttaatgctttggaatatcttcggggaaggttgttcaggtggaagggcaggtggggctggatgcaggagtgtcagattggaggcacagtgggagataaaggaggatgcagacggattacaaggaccttgaatgtcatagtgccgagtctggacttaattcagtaggcaatggggagccatggaagggttttaatcaagccagtgacacgatcccacctgcgttagagaacgatcgctctggttgccgcaggggttgcagcgggagggtatcagaggctgggagaccagggaggaggctgccacaacaggttaggcatgaaccagtgaggtctgagctggagaagggatcgcgagatggatgagaggggagaaaaggtagagattaggatgaaatgaatctgtgggactctagaacatgttcccacactgccggctgcatgcagggactccaccttcctcaaggcaaaggaagaaggatcctgaagtcagagacggatcctgaagtcagagacagatcctggtggtcctaactcaattcccctcctgcaggggtgcaggcagctgagatcatgtgcaaaaccaaacaaggaggaactgctgcatttaccccatgggaaccaaggaatataaatggagggatatgagcaataacaatactgctttatgtatggggtgtcctatgtgccaggcattgtgctcagcaccatacatgctcatgcacatttgatcttcacaacccaatgagacaggtattacattttcctccatttcacagaggaagaaactaaggctcagagaggtaaagtaacttgccagcaagtcacaaactcaggctggttggactccaatgcctacgcgcttaatcatctatttatattatgcacaggaaagagctggtaacaagtggatggctgaaggcttgtgggtctgacgacaaagcaagaagttcccagcctaatcccaatgtgacagcaggaaggagcctgctgatggggcatggagggaaatgtgggggaagaagggaattcctccaggttgctgtacctcatgtgtttgaaatcagacccacatattcggaaaggtgtgtgcccattgtaagagagctgagctaaggagtgagtagtgaatatatccttaacccccagatgggccacctttggagtaattaaagaaagggatccttttctgggggtaagcagccccataggcccatggctggtaagtatatgaagcctttttgcaaattagagaaagatgccccctcctccaggcaggcacagcctgtctttggggcacctgacttggagagtggagcttaaaatagatttcagtccccgctctcctcctgcattaaatgcccttggacagtcaacaacctgcccaactgcatataacagccatgcctccagccttcctgtcctgcacctctgtttccaagcagccactgtgtatcatcaacaatgagaaaacgtccctcctgccagatacacagagctcaaatcactccacagacaactttcttgttaggccttgtctcctccatgggcggaaagacagtcctatcatgcccactgccctgatgaaaagttgaggtcagagcctgtcctcgtggtgaaatatctaggctttctctagagaggccagaatcaaaacacaaggttgtaggaaggagaggcctgagttgagagctccatcttaaaggtgctttgaggaacccggggtggagggtgtgcccactcttgcggggggcatgaggcttttctctctgagcctgacctgaggcctgggtttcctctcagcctgtttccccacctggtccccagcccctagcacccttcctggctcagctatggggaggaatgaggaagtccttggccccggggcctcagcccagacaccaccgtagggtcttctattccctcactccctcccaggccatgcagtgccagctgctacccgtgttatataaacagaaatcattcactctctctcactctacctgaggctgcatttcagattggagcttcctgatggaagaaaaaggggagggggaagaacagagagagagaggagaggaagtttaattggctgactcttatcgcccatgtggtaaataaactggctgctccgaactttgccaactcgggaggagacgggccctcctgggctccctgccttagctatggcccggccccctgtcagacaacttcagaatgcagcgctcctgcaaagctctcagaaagaccagtgcctggggaagcagcaggggctttgggggttccaacctctaggtatgattattccagagcacgaccagaaacatccagagatcacagccacccttttgacagaaaggctgtgactcacccggaggtcacaacacacttttaggggccaaactttgtcctctgcttctgctactcggcgtctctgctaaaggcattcaacagctttcctccggcactggcctgggagcactgggggtctaacttgaacacctcatgctgaatttagagcaagtgtcttcttgtcctgcctgcagcgtgaagccaagaaacggctctgttttgccccaggcctacccaacacataagcagcgttggtgaggcctggatgtcaagatgcctgggttcctattccggctctgggtatagcttaccatgtgacctcgggctgctgttgccaatccttgaaaatggaaaagagggcagcccaggtggtctccaatgtgctgctcacagttaggaatagggaaaggggttgtctccaggggtcccctgatggggccacccaagaggtacaggtgccccttagctgagagagacctggctggctttataaagtacctgcccccgaggcactggcagtggtggaccgggaagggcacacagacatctccaggaagcagtgtttaaatgttggcaatgcccttcccttccaggaggaatggaagaggagtgtcccagacactgggacaaggagggaaataagggtgaagtagagaaatggctggggcagggaacagttgagtgctacagaaaaactgaggcagacaggatagaagatgggtcggggttgggggggacgaggaaatggtcattggtgggcaaagaccaaaggatgtcactatgggtgtagaggccaagtttcaacaagggctgtagactaggggcaactgagggggacggagtgggcactgatggacacatatacgggatacaaatgaaggacagagagtcgcggtggttagggaggagcctttgggccctagggcagtggtgatgctgatatagggtattggcgctgaccagtgggagaagaggatgagatcctgaacctgggtggagagggagagagagctggcaacagccaaagccctcaaatgagccgctgcctgtgctgggggcacctcggccagccccagaaacctggggagtgctggaatcagccccacggaaaaagaagctggcatgcgcaaccctggcgacgcccgaagggtttggagagaagaggttccaaggagcgagcacctcggaagacctgagcagcttcaaacagcagcttctctgcccgccacaagggggtgccctgcacctcggggagacctcgggggatcctggatcagccctaccctctgcagccccgcctgggacagggcccgacgttgccagagaagaggcagcggggaggcgcgagcgagacgggtccacactgtgcccacccagggctgcccggcaccccgcgcgcccacgcagtccactcttcacagtaaacgccgcggcccccgagggttagccctaagtggcgctctctttggacgttaggctgtcgggggccccgtccttcttccccagcggggacggtgtctccggagtcgggtcctaaggaagagagcagcgctggctctcgctcaccgccagcccgcccgacggccatagggcagggggggtcgcgccggtggggccggcaggggtccctgtgggccgcctccccggctcagaggggaccagaaccgtgcgtgtcgccgcggctggagtcagcctccgggtgtccccggacgcggcacgacctcgcacacacacaccgcgcgcacacgctcgcgccgtgcggtattttcccggccccggaccccgcctctgggaggggccggggagccgagccccgctagcagggttgggggaccgggaacgcctgggtcccagccctcgcgtcagggctgtgcgccaccttcccagccccttttggcgcgccggctcggcccctggcgctgccacccctcggcccgcgggggtcccggaggctcccgggcgcgcggcggacgaggttgtggggacgggtgggagctgcgggcttcgggccgagaggcggctcggctccgcgccggggaaagtttggacgtgggaaactccctccccgccctcccggccgagaggagggggcgcgcagggccgggcgcaggcaccccggctcctcctgcggctggaggctcgccccccgcgccgcctgcccggccgctcccgccggccagggggctccctccctgccgggcagcctcccctcggcggcgatccggccgctcctcccgcggcaccccgcgctcttacctcggggagcggcccggggctccccctagtcctgccgcctcgggacgctgcgtggggcgggagccccggcgcgggcagcgggcgagtccggagccccgcggccgcccgcaggagccggagggagagcgggagcgagagggggagccgcggcggcgtgtgcgcgcgtgtgtgtgagcgagagagcgagagagcgagagagcgagggagtgagcgagcgagcgggagcgagggagtgtgcgtgtctgactggggggaagtgtgcaagggacggatcccttccttcctcccgcagcctctggtggagactcggagaatgcagggcccgccgggcaggagccgcgcagcgccaagccgcaggcggccgccggcccggacccccgcagccggggaaccccagcccccgccccccggatcgcgcccctcctacaccaggaggggacagcctttccctctctcgggcggcccagtcccaggaaaccccccaggggacagtgcccctccctcctccaaccccagatccgcgcgaagggagcgcccccaggagggggaccatctacctcctcgcctggcagctccccaggtggccgcagtttgagaccagagcctatttccccacctgattttactgcgaatagggcttcccatttccgccccctgactactgcgggaggccgccttcagaggagcaggggcgcaggccagggtaggagcaggcttctcgaacagtggccgccccggcttgctgcccagaaaggcaccttgcacagaccagatctgccagttcagaaacagtcactgtgcattgaggtggacaccgaccaggtgcccagggctgagtctccaggcaggtgggaggtcgggtgtccccgggagagaaacttgtgggcttttcctctggagagtcccgctggacatccttgcaaccaacaaagtaagcaggcaaaacaagacacctccatccttaacttggtgccaccttgacctggagaagtctcccaataaaatcttcccactgcccagaaactccttgctggttgggttttccgttcttttaaaaatccggctggtctgctccctgatgttttttccacctggccctgtttctttctcctggctgcctggctctccttactacttcatctctctgggatgaggcctaatggaggagaccctcccaccccactcctgagttcccaatatgaggtcgttgatggtaggataggaccagtgactcccatagacccaccctttgtcttgggttgtaggtccccttaggagttgcccgcccccctattccccatggcttccagataggtgagtgaaggataacaggagactggacagctgcagacctctgtcccgccaagctgccaatgaccagccatttaatcacccacaagcagctgctgaagttcatggcaaagagggggcagggccctccaggacccccagctctacctcgcccctatccttctctcctcctcgcctccttccccaatttccatctccatctccacaccctagtccgtcttgctgatgattggaatcacctctcctgctggctgcccctctggcccctcctactaaactccatcattcatttatttattttgagatgtattctccactgtgccagtctgttccctcccctacgtccttctcttggtttatttcccttcattgatctcttccagccttgcctttctatcgccttccttttctccatctctctcttcccctctcctctctattcttagcctccactctttcatgctttcagagaccagaggccagccttccaggtgcatctcttcacttttggttctctcctcccgctctgactcacttttgctgtttgctccagttcccattccttctttgcctcttcctccaggctctggtgtgtgctgttcatctctggagtcagacctacttagttgtccacaggttgttttggtctgggacactgttgctgtcacatctgcatgcacacagtaggtgctcaataaatgttattgaatgaactgttgtcacatctttctcttttgctctggtctctctcttctctctcttttatttttatttttttttgagatgggggtctcactatgttgtccaggctggattcctggactcaggtgatcattctgcctcagcctctcaagtaactgggacaccaggcatgtgctgctgcacccagctccccatgactctttattagaccctcaggttttcctatcccaatgtttcctattttcaggctcattctaccgttatttccaattcttccttccttcaacaaactttctctgagtgtccactctgttgtgagcactatggctaggctctgagaacacattgaatgtttattgagcacttgctgtgtgccatagttctgcttttaagtcctcacaataatcagatactagtattagcccattttacaaatgaggaaactgagacacggtgttgaaatagcaagatcattcagacggcaagtagagagatcaggttgacgcattgggcctgggtcagacctctcactctggtctgggagaaggtaagctgggactcctgctgcagtgtggcaggggcagcaagaggcagtgtagtgtgacagaggaagaactgggcaggcctgggctctgagagcagttctgccccatgcagactgtgtgacacgtgggcaagccacttcccccagcattgatgtgaagagaaaatgagatgatagtaacaacagttaacatttagtgaacctgtgccatgtgtcaagccttctcctaaatgttttacacagataatttccttttactttcaacaaatttataaattcataatggggaaactgaggcacagtgcaactatgaaacgtgcccaaggtcacacaattagtttatggcagagctgggattcaaaccaaggcaggctggggccaaagcctgcacactgaactgttgtgcaatattgcctctgggcaaataaaatgccaagtgctttgtagttagagtttgaacgtgtgcttttttatatcgtgtggtgagtctacaaataagagagacaccactcctccagggattgggtaggatgaggaaggacttggggagagaggcatggctagggaaggattccaagaggaggcgcttgtgagaattctccttcccactccatcagaagggcacacagccctgtcttggcacaggggacatgttttcccctggagtagtcatctgggtccatgggcatttctctctctctagcccagggtcactccactttggccctattgacatttgggccagataattcttcgtcattgggcatgtcccatgtaggatgcttagtagcatccccagcttctacccactagatgccagcagcacaccccctccccagttgtgacaactaaaaatgtgtcctgacattgccaaatgtctcctgaagggcaaagtcacccccagttgagagccactgctctagtctgaacgccctaacagcagggtctgctccagggagcctgcaggtttgagcaggggtcagtgaagggtgtgtgtgtgtgtgtgtgtgtgtgtgtgtgtgagtgcatacacgcgtgtgtgttggggatggggaggctgctcttagctccaggctctgctattctccctggctcttttcctcttcttctctacacttctctgtcatccctttatctgtctgtcgccttctcatgcactgtccatctgtcctcgcttctctgactgcctccactcctgtctctgtctcctccccctcagtgtctctggtctctctgactgtttctgaatgggtgtcagtctcttgctacctgcccctacatcttctctagcacccttctcccctccccccatctgcttatctcctagctgtgtccctgcgtctgtcgttctctttccgtttccccctccctctgtcctgttctctctgcctccatgtctgtctccctctctctgtttctctgtctcttcccatctctgtttcttcggggcacccagtctccctctgtctccctcttgcctgtcctattctggttctctctgtcctcatcccgcactctcagtgccccgtttccctttctctcttctccccacacttccttctcctcttcctccttccctccttccttcccactcccctcctcccgctcccttcctctactctccccactctgtgcttcccctcccttccctcccttcctccccctcctcccgctttgtctgtgggagctggaagttaaaagcttttccgaacttgttctccagtcgctgttcccggcgcctttcatctcgccagcacatttgtaaaactgcgcagactgaagggccgtgacatgaacaaccaaagaaatgtcagcgcggggacggggccgccagcccgccggggggcgtagggagcagccggggcacaccctagcccctccccagagggacccgggacccgaacgagggcgccccacctgggactccgggcgctctgcacctctgcgagcccgctttctccgccggggccgacgggaccgcagggagggggaggggactacttggggaggggactccatgggaagggaacttcgaggggacggggaggccgcccttggctgggggcgccaggacggggaggggcgagcctgcgggagccacaggcgccgaggccgtgcgcccttaagcacctccacctcatggcgttaatcctcgcagaccccgcagccagactgcctgggttcaaatcccatcaccgccacttgccagctgtgtcaccctgggcaagtgacttcacctctccacatctcaatttccttatagtaaaatagagatggtgaagattggatgagcaaatccttgtaaggcacttagaataagtgtttgctgtaattaataagaagaatagcagcaacaactcacaaaacagggttatcgtccccatgctaccgctggggaaaccaaggtttaaggggagaaagtgacttgctggacgactcagaccaagtcaggggacgaacaggaatttaaggccagctccttcctctcctttcccctctttttcctcaaggaagtgggtgcagggatggaacacaagttctaggagcttaagaattgagtctgttttgttcactgcactatcctccgaatgcagcatatagtagatgctcaataaatacttgttaaaggtatgcatgaatgaatgaatgcaaatgctggaaaggtgccaaggttagaaaatggaaaggctactttgtctgtggtgggctggggtggggccaggtgggaaaaacaggagcccagcacctgccaagttccaagccttgggaacttggcactccatccagggcctaagcacaacggcagcactatggacagtggctatggcccaggccaggatccagctttacaccggaagctctcccgcagcctggtgggcccgccctgcttctgggcatgacatctcagcccacatcccagctccctaaccccgctcctgtaacctctgtctggggctaggtcccaaccttctgtctcctacacacactctgtctcttctctctctctctctttggacccagatccaaagccagtgggaaagacgcgcctccctcctttccctctccctacctgtcagccctagacagcttctgcagccctgaggcctgacactgcaggtggctgcgtggagatgggaataagagtcccctgagcttccctgaaagtccctaaagacacagcagagtacagcagaaactgagcacttggaccttccctcttgagcccccttccctggggtggtggggtgagacagccctaccacactccccacacacacttcaaacaccgactctccctgaattattcacctgcctctccccagggctgctgcagagcgcccagcccaggtgctgaggaggaaaaaagcagaaaggcccattaaatttaaacaccgctgaggattgtcagatgtgaggttctattcctggcctagagaagagccgccagtgggaagggaaaggggatctgcaaggggatgaggacgagggacccaccccgggccgagtgacctgctgagcaccaggagggctggggccaacatgccagggaacccggaccttccttcacctgaaggttctcacccatgaggaagtggactttgccgtaccatttcattcatgttgttctggcaagagaggaggacccatctaagaatagcttctctgcagctacctgaaagcccaccattatggcttcagcatgaggaacagggcattgcctctccagcttcctctccagctgtttccttcttgcaccttatattctggtagtgccaaactcttttagcttttatccactctgagcttttttaatgttgtccctgccacctggagctccctctcttcctctgttttgctggaaaactcctatttatcttttgaaatccagcttaagtattaatccagcaggtggcatgaagctgtcccacctctgcactccactggacctggaacacatgtccctgttttcttccctcctcctgcccctcatgggtagcacagcccttgactctcatgcctgatggggccatcacagatgacgacttcttaggaacaggcagttggatgccacggagaaagtgctaggtatcctgagaagcctaagatcttccggctgtggctccgacctcaactctctctgtgttttgggcaggtctctagttctttcttttcttggcctgggttttctattgcataaaataaaggaggagaggtgggggaagatttcatgatgaccaagagcccttccggggtccaggattctctgctccacacgtaattttccaagccctgtcttgcgtcttccctgtgtggatgctgcctggcctttctcttgttgacacctgaagcagtgatgtgctggaactggtttgtgctggcttatcaaagccagttgttagagtctttttccaggaattttgcaagccaggttggcaagcccttgaaattggccaggttgagaatatttacaccacaaaaaagaaatgataaacaatacaaatcagggcttgctccctgcttcccccagagccagctcacctctgcctgaaggtctcattcctacctccaggccttccacctccaggcctttgcccatgtggtctctggctgagcagcctctgctccatcccttgctgtctgttctctctcaccaaggcttcagacttcaactcatacctcacccactcagagctgagtgcttcttccttcacccgatagtgctccttactgccaggaatgctcatttttcgtggagaaaaatacacactttggagcagacagatccaagtggaaatcccggtcctgctctgtgctcgcaaggttgtctccttcttgtcagtggcgctcctgctcagctgttacctgtttacagagaacatccctgaccaccccacggcaaatggcacttcacccctattccatcttgctgtgacatcacccaatcttttcaccctgctttaacttctgagctgttaccccttcctaacatttacatttatttattaactcacccaatgcccatttctctctctaggatgtgagttctgggagggcagagatcttttctgtcctgattgctgctacatcctcatctcctagaaccttgcctggcacatagtaggtactcaatcatttcagtgactaaatgagtgtgaccttgggcaagtcatgtcacctgcctgaatttcagttgcctcaacacctcacctggcaggatgtttggcaggtgtattcctggcctgagctgccttagagaaaggccaaggactgggatcctagtaccagccctgccactaactcgctgtgtcaccttgggcaagtctcgcctcccctggcctcagttttgccatctctcaggggtcagatgagatgacaagcaggagtgaggtgtcatttcaatctgtgggtcccatctgctgctccctcccaccccctccccacctcattcattcattcaacaaatattaatgagcatctactatgtggcaagcactgagaatacaggaccaaatgtggggatgactcatgggctcctacatcccagttggggaggaaaataaacaagataaattcacagaataaatagaatgtcagagggtgatggtaccaaggaaaaattaaaagctggaaaggagcacggggagagttgaagagggggtgtcagttttaggaagtggcgggggagtcagggaaataactcactgggaaggggaaacataaagaaagatgcaaagaatgccaggtgtggtggctcacacctgtaatcccagcactttggaaggccgaggcaggtgagtcacattgaggtcaggagttcgagaccagcttggccaacatggtgaaaccctgtctctataaaaatacaaaattagccaggcatggtggcgtgtgcctataatcccagctactcggggcgctgtggcaggagaatcgcttgaacccaagaggcagagattccaccactgtactccagcctgggcggcagagtgagactctcatctcagaaaaaaaaaaagacataaaggaggtggctccctagggtagagggaatggcaagtgcaaaagctggaagcagaatgggcctggtgtgtctggaacccagtgggctgaggccacagatgggacaaggcatcctacccctccctccatctctcattaggattaggaagatggtcccaaagagtgtgacacaggagtctcaaaaggaagatggagggactcccctgtgcctccctccctccctcgccgcctgggcgtctcctgagtggggagcccgggctcgctgtgggtgtcggcagcttttggatcagcaatttatctcctggtgcctcgagtttcctggagctgggcacttcctccccactcagccccgctcccttgagcggcaaagacaggtgtgaggaattagctgtggggactaatgccgtgacaggaaccggcacaaaagaaggggacagagtgtaatgtttattacgtttgaagcaaagcaaacatgcggcctatttatgtatctatagagaattaattggcgagcggcagcaagaagcagattataaattagaatcattttcgccaactgaaacccattcatcttgcttcagaacgggcctgtcacctcctcctgactaattccttttaaatttgctgctttttctcaccggccccccgcagctctcacctcgcgacctgaaccccacgaggggtgcctccgggaagggccatggccaagctctgtgcttttctgagcccactctcttcctcctccagcctcctggaactccccccgtgccccacagctggtcctgggcctgagcccatgccttgcactgctgtctctccttcccctctgctctggaacctccctcagcccctctctggctctggcctgtcccctgagaatccggcaggttgggccccccaccagcctcaccttgcagaggctcaggccaggctggtggttaagggaaaagggcacatggggctgccatccggggggaccctggggcactggccactgccgcctgcttttgattctgggctccacgggaatcaaagggaagccacgctgctgggtccctggcaggtctggctctggcttctctcacctggagcctgtggagatgaaaggccagggcaggtgccagaggctgccatgcccaagagcggtgctgtgcctgccctgggctgtggcccaattaacccttcccttccttctgtctgagctgccgttggtcctttgagtctggcaactgcagggaaacctttgtggagaagagaaagtagccagaatgtgagtgcctgggactgggacaaggtagctaaacatcagaagcctaatggttcaaggtgcaggccctggagtgagcccagcctaggtttgaattcaggtagcacctccccactagggtggcacctctctgagcctcagtttctttgactgtaaaatggagcaggtggtagtagtgcctatgacctgaagcaatattcagccgggcttgttaaaatattgcagtatggggccgggcatggtggctcatgcctttaaacccagcactttgggaggccgaggcgagcagatcatttgaggtcaggattttgagaccagcctggccaacatggtgaaaccccgtctctactaaaaattaaaaaaaaaaaaaaaagccaggcatcgtggcaggcacctgtaatcccagctactcaggaggcttaagcaggagaatctcttgaacccaggagacagaggctgcagtgagccaagatcatgccactgcactccagcctgggtgacagagcgagactctgtcacacacaaaaaaatattgcaatacttttgtcctggccagcccatggaccaaatgttctctcctgctcccatttcacctacggacacctcctcttgccaaggtccaaaaactaaaggttgactcctctggcggccgtgaggacctgctgcagcctcagtggttctgattgatcctacgtgctgaactgagggttaaatattttgtttatctgccctgcttgcatcccacagatgtcatgaagattaaacaagataagagtatggtgcttggcatccagtaggtgcttaacagaggtaggtatcgttggcgccattattaatttggaccaagtctctaagcctggaatcctggcattccaggtccccacttttccccacctccccaccttttaaaaacattcaccaataacttccagcctcccccatgaatgcgctgttcccaccccagctgttgggcctgagactctctctgtgctgagctcctggaatgtgccagagcacggacctcctgcgttgggaaaccttcttctttggggatgttgagtctcagaggcagacctggagtccttaaggggagcacctcagctaactgacctctgtgctcccttctccccagattggccacagcctaggggtgtccaaaagtcccaagactgagacagagagacagattggcccagtactgcaggcagcattcaggcagttgtcaagggcctatggaaaagttcaagatgtgaaaaggaaaaaagaaaagataagctccaaaatacaaaaagaaaactgcaaaatcaaaattagtaagtgtttaattaaatgtctacaaaatctagcattgtgccaactagtcagtgccaattctgttcatccctcctctactcatgcataggagaggtctgaagtgggagtcggtgcattttatgcatgtgctgtggtgtggcacggggaccttcaaagcaggagtgtgctggggttcaatctcttgggtcacagctctgttccttgctcactgggtgaccttgggcgagtcacctccgctctctgggcctgtttcttctttcttcctctgtcaaatgaggagaaccacttcccagctcccagagtggctaagaggctatggaagcatgtttcaggaaagtctggcaagtgctgatctcgtgttgtgggaatccagcaaggggagggggcttgccaagacctgctgaagaagacttgaacctcaacctctgagctcctctctgccttgttcccctgcacagggcatggacaaggacgatattcgaatgtgtaacagttaataatggccattggagcaagaccctggaggccctgctgggccacttgtaacccattagttgctggatcctgggaagagtcaggtgttctggggcagagctgggtgtcaaggaggtgggctgagcccttgggaaactctacacaggcaaccacctatttgcccatcagaatggaaagatgtcagcatttgaacacctggcacagccctagtgacgtgtgctggctccacctagcctgtcatgggtcatcctccaagatgggccaggacacttttgtgagtgacgtggcatttagagatcattatttatatgctgaccctatgtcccagagattctgctcctgggtgtaaatttcagtgaaattctcagcatgactgggaggaacaagtctgaggattcttgtgcccatgctgtgttgaggggagttggaggcaacccacctctcctccctgggggagcgtacaggaagacatgggagacacaccctgcagaggtcctggcaactgttagacaagtgtagagatggccatggacggatctttaaaacatgagatgaaaggagcgaggaaccaactgggatctatggcataataccatctatttgaattaaatgtgcattcagatggtgcttatatgaatttatatgtgtgttgaaatttatagaactatgcgcccaaagaaagtcaatgttactttgtgataattgaaataaaataaaacaatataaaataagacaagtgaccactttcagagggctcatagtctaggaggggagatacatacgaaaaaattgcatttatacaaaatcatgctcatttgcaagaacacatataaaacaaaggatctcttgtgatcttgctccattatcttgctccaggagctcccaggttaatgcagaagacagacagaaaaatccttactccagtatcatcagggctgtgcatacatatgaggcactctgggaccacagaggaaggaacaatttattctgtctaggggaaccccagaaagctgcccctgaaaacaatgatatgtaatttgagtcctcaatgctgtctacgaagagttcatggcataatatgatctccctaccagagaacaggcaacacttaatccaagggaatgaaattgaaatagtgggttttagttgccatgggagaagatgtagttggccaggggtcctttcaggctggggacacttcttgccttatcagcttctggtgtctgggccccctgcaactcaagctgggattgaataggcaggctgtgtccccatcccgagaggcctagcgtggttccctgagtcggagaagaaaggtggccctccttgcatctgcctgggaggctgctgtggccttcctggactcctccatcctgcttccaccttcaatccatcaccttttgcttgctccccttccatcccagtagcacatggcccaagcacaatccctggccagccctttcctgctttatcaccagtctcccttgtctctctctcacacaattccctttatcctgtagtccagagagagcatcctgaagtcaggtcttctctggggctctccatgtacagatcttcatggccctcagtgcagttccatcccctctcctgggctccccagcatgatatctccctgttctcactgcactccttaccctcagatatcgctagaccacctgagtgctgccctgctttgctcacagtgccccatcttttggaattcctttctactttccctcctacttcccccagctaactcctatgcacccctcaagacccagacctcaccccctcctggaagcctcactcatcacccaggactacaacccccaaacctctcctattgcagactagagcacactgaattgaaaccgtcttcttacttctctgttaaagggcttgggttcaaagagctggctttagatccaggtgcctgaattcacatactgattctgctgtactgcactcttggaccagttatttgacctttctgggccttctatttctcatctgtacaatggaaatagaaagagtacctatcagaaaaataaaaacaaacaaaaacgctccaaaccactcaaatacccacctcatggggatttggggaggaataaatgaagcagtgggcatgagttcttggctcagtgcccagcacatagtaagtgatcaataaatgttggccattattgtctgtctccctccaccaagccaggagttcctggagatcaaggcagaatctgatctgcgtttgggggcccagcacctccccagggtctacttgttgaacagttatctgccagacattccattactgtgtactaagagattccacataggtgcccaccattagcatatttgagccatgggtcttagaactggcactcagattggagttgttccatgcttttgatctggggcctggcagtgtctatgatgggagtgaaggggccaccgctagccagatctctttccctggcctccactcacctgccccctggccgggttccagcctcccactcaagccatcctctctgggtgatgtagcatgtgaggcagaggacagggtccggagtaggagccatcaccagccagactgcccttggtcttgccagaggcctccttggtgcccgcctgcctggctcctgcctggctcccagctcagttgcaacctttcccaactaggctttcctgcctgggtggcccttggcctcattaacaaggaagtgttccttggcagcattactaattagcagcaaaagacgattagtgtcattaacagactcaaaacatttgtattattagctccttggtggtttggggttgcctggacctaggtagggatgggagcctcccgggtggagagtggacttgagagggagctggcaggagaggcagtgagacagaggtggcggggagggagctggtgagaaaaaaaaaccacgaaatttaaagtgaatgaattatttactgcaggaaacaatcccggactcactcactctgactcagaacatcccaaactgtaatctgcggcatttttcacatctccctagtgtgcggagtgattttctttacaattggataccagaggccgggggaatcttgtaagagattggcttagtattgatcatgtgtgtcttcctgggtccctggctcccacccaccctcgaggctggcatctccagcttggacaacaccctaaggctggctggggccagagtcagccccaagtgggagctgatgagggggccatgaccctggtgagcatttggagccacgagaataggccccttgccctaaaatgagctgaatgtccctgtttcggagtcacctcaccccagcatggtcactgaaggagcccctgccatgttgccatatgtttcagatgcattatgtcattatcccttccaagagtcctaggctagatattattaatcccatttttcagataacaataagagctactctttatcgacctctgcctaggtcctaggcaccgtgctaatatctttcatttattatctaattgtttccttaaaacagccctggttatggagagactcagagaggtgacgtggcttgcctagagtcacacagcaagtggcagaattggccccaaatcctggtctcccccttgccgtcacggggcacacaccgacccctctaccccgggcagcaatggaaggagggtcaaaagataagggacataaaacccagggtaaggaaagacagcaggtgttccctgctactcgggtgcccctcccagtgactccctgacagggccatgcttcacctggaaggacgtgtctccaacagcgagcatcaggtggcgtggagcacgtggagcacagcattgctcactcatggccagaggctgtcttcagagcagagatgaggagtctggctggctgggaggaccagaaggaccctgctgggctgacaagtttcgcctgctgcaaggtgcctctggccctgagggtggggggtctccatggagtcaaggaggagagaggcggcgctgagtgcaaggaggcagagaaagcttcccagcaacggcaaaatccaggctctggatctgcctctggcctctctgcttcccttctaaggaggaagggaaggaacctgagtcccaggctctggtcctgacagggctgggcaactttaagtgggtgcccgctcttctctgggcttctgacttttcatctgtaaggtgaaatctttgttgcttaaaagggctccttacttgagttccagtcaatgaggtcagccgttgccctaggtgtaaaggtggggacagggtagtaggtgccaaatctcctcccaccactgcctacacccccaccccccaccctggaatgctagcctgtcggtgtggcagtgacctccaatatcggtggtgccaacctacccattttatagatggggaaactgatttatagagatgggagtggaggtcacataagggatccgagcctatgcattctgacccttggccaaactcctctttagtcagccttacccaggctgcaggggcaatttggctctaaggccactttgtttgggactgagggaccacaggcacaggacaggcagagggagcaagaagtggatcccacaacaggcttgtggctctggcattcggccacttttctctgtcatcgtaactgtaaataaggcatctgggagtcctcccagcactttaacagatttaacaagcagtagcatgcgacccgcagtccaaatggattttttaataatgaataagcatttatttaacaagtaataacagttttaccaccctccggatcctcggaagtccagaggtcttgcattaacgccttacacaggcatcttctgctgctatcttttgtccatttttctggttgtttttctcttattgattggcaaaagctctttgtatattaagggtattaaccctttacctgtgatatgcaaatattttaagtctgtataattattaagttttccttagggcatatagaagtttaaatgttttatgttgcaaggtgtttttttgtttgtttgttttttgttttaatttagagacttctgagttttcagaattgcttgtgagcctgaggaaacctgtggctctgttgcagaaatcctcagctgagttcaaacacaagagccctggccatggagtacaactgtgggtgaatgcctctcttgagacctcggtggcctccatataataatgtgttgaaatagacaacctctcagctgccccctgcaggaatgtcccatgattgtaagatgggattttgcagggaagaggctgcagtgcactctgagagaggtcccagccatacagtctttcacaggtctatctcccccaccacttccagcccctttgagaacaggaactgcgtcttttcattgcgctgtccttagcaccttgcagaaggctgcctgcctcatagtatgccctcaggagaaatttacccatctgcactgctgattgtacctggaagtgagccctggctccatttcatgcccctgtctagaggtggtagaatggagtggataagacagtgtgctccctgggtttggatattgacttttgtttgctggctgtgtggccttgggtaagtcgcttcacctctctgagcatgtttcttcatctgtaaaactggggcaagtcctcccagagctgtctggcagcatgaatgaaaaactgatctagcagccaaaacacatgattcctgccatgtcgtgggcaatcaatacacgtcaggcctcttgtatctccactgctgagtggagtgcattccatcttgagatgctaaaaaatcttcagtgttcccacagtttgggttccagagtagaccctgagaaatggattcaagggcaagtaatttatttgggaaatgatcccaggaagcaccagtaggacagtgggaaagtgatacaggaaaggcaggcaaccaataccgggtgctttatcaagcctgttactactgtgggcaactggagctcaactctgctggggaattctgggagggagaataggactcacatcacagagcaatccactcccattccccagcaaagggtgagggaggagctggggtacttatactctggcttcaaatagtcatcagttaagagctggacattaatttcctgactctttcagtctgcccactgggaagcaaagtggctctggaggcctgagaaaggaactcaaccaggcatgccctgaaaggctaaagatgaggtcctgacacctttttggaagggcaggtgaagcagacatctcaagtaggatggccccaaaagatttaaaggtaggattcggtggcagaaggggagttaatggggcctgattctttgttgctctccactctgattgccacctgaaattgatagctggtaccaaagggcagtagtgtcacctttcaataagatgaaatctatgtctccagcggatggagacgacaggaagatttatcaaggccctggcaaaattaacatttggacgggggacacggcaagaacagcctccagagggggtctctttgcatttattctggctggttcctgccagcggctggactggaaagagctgcaggggtcagccatccagctggcctctcagggagggacgcctggacagacagatgcagacacccagggcaaaaggagactggaaggagaactgtcatctttgctgagcagggaggccaccagggcacttggagctgagtccttgccctgccactcacttgttgaaaccctttgcctcagtttccccatttgaaagacaagggtattgtgctcaatgcttctagctctggcaatctctgagaccatgacacagaacaaagctctgcccgggtgctatcccagcagtcttgggaggtgagcatgaatacatccacagaatgatggctagcctgggttgagtacctattacgtgtcaggcactgtgataagtgctttacttgtacttcctgtaatacttacaatagccccataaggtaggcacggtggtttctgcattttgcctttgagctcagagaagccaagtgactcacccaggactacacagtgagtttggggccaggtagacatcgaaacccaggtctaccggttcccagtgcagggctccttccactgtagtcatcctgggttccagttccaggccctctgatactgaacttccaaaggagtctcaacttctctcttgcacaggaggatgtatccagagctcaggttctggatcaagataaacctgggtttgaatctcagctcaatcaggtccttgccgtgtggcctggcctgaaacattccacgggagcctctgtttctttgtaaaatgggcattggagccatgtctatcatgaagatgacatgaggcaacatgcgtaaagggccggtctctagggtcactgggaaacaggcttccatgtacggcctcctcccctctccattattccactgtggacttgcagagctgtgtggtttgcatctggggcacatgtgggaattaatttgtgctaaggaggtgaggtcctccctccaggtgagcagtgtgggacaagggaccccagcaggcctggaggatgctgggacagaggcctccgctcagagaaggagaaaggcagggccgatggaggaaaggcaggtgttgggagcaagttcccctgccccacctcagacacttgcactgaatgcgccctctgaagccccagccttctaccctggaaacaccctgggccctggggtggaggagaaggaagggagcccttggtgggagctacagaaaattaaagctaaaaatatgtctgggtcagacctcagtttccccatcggtgaaatgggtgcaggcagtaacacccccaccttaggcctatttgagcgtaacggggtttttaaagttgggattctaggcccctcacaaacctgaaagacattcactgtgggtgctgtctggactctgagcaacttacttaacccctccatgcctcagtttactcgtctgtgcaatgaacgtaatcatacttaatgcactgggctgttgttaggatgagggggtgaggagtgctgtcctgaatagcactaagaacagtgtctatgtctaggaaatgctatgcaaatcatggttgttgtttttattactaatattattaatatcattatcatcatctcaggtgagggaatgcggggcccggagaggggcagaggcttgggaaggccacatgatggtcaggactgtagcctaggagtctggccttggaccacagcctcagcccaagtcctcaaacatcccctcccccatcaaggctgccacatccccctccctcaccagggagtgagaggaggcccaaatccaattagcctgggagccaactgcagagcatcgcccctttaatatcgcaggagaagctgcagagataaatgagaaattagaattccgctggggtccctgagacccgcctgccggcccgccctgggctggggctgcggcaattctcctagggacccaaggagctgtctgagccccagtggaggaggtgcccctgaggggccctgggccagtgcctgagtttctccttaggcctgccagccgctcctactcccagcctcccattgcccacccaccttccccgctgccgccatcccactcccctccccgtcaaccatagaattcacctttcctctcgagagacccattcctctcctccttccacagcccctccctcccagtatccgagggcatcagggcaaggtctaaccccattcttggcacgcccccgcttccccttcccactcccctcctctcagtcctaacaaaacccaggatccttccctccttgggctaggactgactctgcagctgaggcctctcttgggcctgggggattctggggaggacatcactagtccccctcaaggaagaggaggttcagggtctgtaacaggagctcctcctgagcgttccagagtaggtgtgcaaatgaggcatctgcagccccctcctctagagggtaatgggctgtcatacaaagccggcaggtcaccaccacagccctgctgtggccttccatagctccctgtcttgcacaagactcagtttccccttatgtacaatggagaggggctgacataggtgcaggcctaagatcttggcttggacacttggcccaaccctgggaagcaggcaggcccccctatcatcaacccagcccacccacctgcctccctccctcgggggacatatttgctgctgggaaagttaatccattacagtttaaaggctccgttcctcgctggcagtaaattacctgctttgcattttgcagcaacaacttaacggtattaatttattgtgctctgtctttaacaaacatcattatcatattgccagccaggattatgcaaatgggagggacaagggagaaagaggctgaatcttgtccccaaagtcaccttgatttattaactttggggccctgcaattggccaggtctgggaggtgcaggtgagtgcagaggccaggagaacccacaaagtctgggcagagagagtcctgaggccagagggggactcccaggggagggcacccttggagggaagggctggctggggcttagagggattcccttgtcaggtgactttggacaagtccattctgtcttgggcttcggtttccccacctgtaaatggaggttgaattaagaggtccctggagctcataacatatgaacttgagattcagcaatacattgtgaatgagtgagagagagagagagagagtttatgtgtttgggcagggtgggctgagtagagaagaagccacgtggtcctggggctgcagtgcccccatgccgggctccctggctgctgcggctcctgagcaccaggctagtcatggatgggcacatggtgggagatgggtgagctggggctgagaagagaggggtctaagggaaggggctacttctgggctgagagtctaaaggctgacggcaggggtcagttcatgagagggtctgagacttttaggctatacaccaagatgctgggttgggaaggggaggcaggaccatgccaggctgggaggcagcaccctttagctcctgattttgcatctggcctgggggctgggctggctggaggtctactcatggggtcctaggcctccgcacagcctccggcagctcctcctgagcctcctggactctgagtttaccccgagagactctaggttgggctgccaggggagctggaggcaggtgggctgggccccccctctgcccctccctgtgcgcctcctcccttgggctggctgtggtgagaacccgcctgattacacagctggctgcccccggccactgggcctgctccccaccacctgcagactggctctgccaggaactcactgggactacatccaagcacccgtgggcgccagcccagggttctgccctggccatcagggtccttcccgggccctgcagaggcgccaaggtgggagctggagaggggccaacagagaggagatgacaccaacctggctggccaaagctctggcctggcgggtgtggggtggtggggaattccacggggagggtggcaccccctgtctactgaattcctgagtggccccctctgtggccccatccctgccctgcctttggcattttgccaaacctgcccttgcctcctggtgccccaatctctgcctcagtctctgagcacccccactgccccctctacttgctctgtcctgcatcgctgtctctgggtctctccctgtcatgggggatggggctagggagggagcaggaagcagagggaagaggtattgagggggcatggagtgggggagcaattcaatttccagagttggccctggcaataccggttgtgtcgtgataagaaagccatttcccgtgatggctcctaatccacaccctcctgcctttgcatgcagcagctcccttcatctgcctgtggccagaggctggaagggatccctgtccactatggaaggggccatgtctgctccaaatgaaccatgctgagcagcatctgtgtggccgggacaaagacccatgccgaaatctacaagcccaggagaagccgtcaaacccgatgaataatccctcggactgttctaaattcagatggacatgcacagctgtgatctaatttgagccatacatctgcccttgagagaagtagggatcactcccattttacagatggggaaagtgaggctcaaagtggttcagtgatttgcccgaagctacacagcaagtgcgtgtagagagaagcgcaagttgatgtgtgcagggctgaagtgtgaggtgagggtgcagtgcgggagccgcagcctgggcttcgaaggtcgggggagtaggggaaggaggggaaggagacaggcagggagtatgaggagaggtgaggagaggtgtgtgctgggcagcagctcggtgggagcccagctaggaaaggagcctcggggtggcctcgagaggattttagtgctgtctgggcagggggtctgtgggatacagacctgggagggatgggggcatggtggtcagagaaagaagctgctggaggacacaggcgagccaggaccacagtcagggaggcagctgtgactgtcagcaggaacacgggaatcctctacgagacacctacacctgagtcctgacatcaaaggggtttctcgcctctccggtcgcctggtttggagctcagctttcttgaaaactttcttcctgccagtctcctgcacaggccctggacactccttgggctggactgggccccttttccagccacacccttcactggctgggagggttgcagggaggcctcgggctgagccaggcccttctgctggctcccctgtggcccgcaggggcagaggagggagggcagctgggctggggattcaacaggaggggcagtctaggtgaagccagccaggccctcctgatttgctccccaccaggaagttttctttgtttgttttggtttttcctttttgttttattgagacaaggtgttgctctgtcgccctagctggagtgcagtggtgtgatcacagcttactgcagccttgacctcccaggctcaagtaatcctccagcctcagcctcccaagtagctggaattacaggcacgtgccacctcgcctggctaatttttaaactttgtagagacgaggtcccactgtgttgtgcaggctgatctcaaactcctggcctcaagatcaaagtcttggcttcaagtgatcctcctgcctgcgcctcccagagtgctgggattacaggcatgaggagaactgaccaggaatacaagcaaggatggatcccgaatcctgtttgtctccctctgcatccctaccccccactgctgactccagaaggcctggtggggagcggtggtggatctgggggctacaaagccgggcaggattgtttaccctctccctaccttcccctcactggcccaactgtgatgggggtgagatggcaggctggggctgtgggaggctcccagaacagctggtggctgtgcagggccgtgggtggtggcaagtggggacctgctggagcaggcaagctaatctcatttggttgctgcagtcgcaaacaaggactgcatgctaagtggccagaggcagcagcgggactcagggccgacccaggccccacgcatacctgggagcacctagaggccagccctggtttgaatgaggagccatgttgggcaggggcaggggaataaggagggggaggatgcgtcttgtggggtaagaggttactccccgggaaatacctgctgggagatagggcgccagggtcagccagctcctcccaatcctctggcctctcctcctctagccctcctcctgtagggtcctggatcagatgccactgggcaggaggcatctggagagcaagcttcatcccctttgccagcagaattgtgattggagagagggacccgcctgttcacagcagagcatgagggaggcatcggggaaggtgctggaagaggggaggggagggggctgggggagccttgagcctcgaggccctgcccagtcactccactcctctgagcctctaggggcttgtttagaggcagggccagggaggtgcaagaagatgccctggctgtaaaaaggtgattgggcttgcgactcttgtgaaatggtctgaaactatctttagcttagatgggagtgccaggcttgcagggcccaggtttggcagatgagccaggccagaagccagtgccctgagggcttcctgactgccacccacactctccgcccggctgccacttctcggagcagctggtaccatcagctcccagggagaatcctgaaatcacacaggtagctctggtctttgggcaaaggtttgtgctctagacgtgggtggcctgaacttggggctgcatcatggtaacagatggatttgaaggcagagcttgcaagggagtccagatggccacagccaccatccaggtctgtttttggtacttgctgggcccctgtgggcagctccatttgcaacccctttggagctccttagctcaggtcttgctgataaaaataagccctgccaatcacagggggcttgaaccactctgtgactcagcttccacatctacccctgaggggctgctaatgaaatgaaatgaggcatctcaagtgtcctgcccagaagccggtgcaaaggaagttctgttttcgttttgcagcatctcagcccagtgtaccacaatgttctatcattacagtctgatgggcctttagaaaaacggctctgcttcacttgctgtgtgactgtgggcaaatatcttcacctctctgaacctcagattctccatctgtaaagtggcaacaataatacgtactttataggaatgttgtgaggagctaaagaagaatataagcaaacttgaataaggcaataaatataaacacagaacagtatccagttggcaataggtgcttgatcaatatctgttgcctgtgcaacactttacttttcagggggatacactgaggtccagagaggggaaagagttcatccaggatcccagctggatcaaaggtctcctgatgtctgctggaggaacaagagagaggaaatccctggccttttgtttcaccaactgtaaaatgagagggcttcaccgatctatggtttccagctgggatctgggctctcgggggccactgttggagtcaacaccaagcccgcggagctccgggaccaccttttctggttctcagtccacgtctctttcactcgtgaagggctgcggaaggctccacgtgaacaaacttcctgccgctcagccttgaatgtgtgaaagccccctacttgtttattttcagggctcctggcagcgcagactctctgggacagggattcctcccaagacccctgcccaggtagaccccctatgtcctggcctgggtcagggttggctcagctgcctggagtgggtgagcagaccagaagcatgaccctgccccacccccagccagctgcagcccgggcctgggatgctggttccgccagcagttaaagtccccctggttgtctaatttaatcacagctgtgtgcacggtgactctataaataatttttagtgcgacataaccattatttcactaattgcttcacgcgcacccctggcctgtgagataaattaaggtttgctgagtcagcacctttggctgatgctgctttggggtttggaagtacagccccaacaactgggctgttcccacaccagcctcagcccagcactgaggggagggcgcccctcacgtgaagtggccaagggtagaatgagtgaggaggaatgaggaaagggctaataagggtggccatgtacagttgcacaggttgtgtcctgcaccagggtgcttggctaagggggcaagtgggggctgaaatccagcccatactacacttttgcaatccatgtgctctgacatgggattttgttggcccagaagaaggtggtaccttcttttaatttgcacaaaggctaggaaggaatcagcagctccagaatgaactaccacatagcaggttgtcagggccacctctctgagagaggaggccaggcagaatatccttaaggatcttctcatgttagcaacagcatggagacccaggctctagatctgatgctgagtgacctgggcaagtgaccttccctcctctgtgttttaatatcttgacagtttgatcccatccagagcctgtgttctttcctctgcctatcatactccaaattcagtaggtgtggctggaaaaaaaggttcacatggtcaagtacatttgagaaacatcgagttaagtggtttctttctgtagaaattttcagagagcctacagtgtgttcaggagcagcagacttgcagggaggggtggagatggtgtagcttttcccagtgcatttggctgtggaatccttcattttaggactcttattcatcctgggatcctagtgtctatctctgggcttattagtgagtggatgtcatccccaaggacagagaacgctcctattcctggccataactctagactcaaggcacttccctatctgtcatctagatctgatgctgagtgaccttgggcaagtgatgcaagattgcgagtgggcaagattgctagatcttgccttccttctttgaaggaaaatctagcaaaaataggtctcccttcaaatcggtgaagtgtggggggagcatcctgagtccacgggactcgaagttccttgagggcaggtgctatgtctaccttatttattgccagttccctggggcttagcttgggaccatctcttgagtgaatgaatgagtgtctattttgaaaagagacaggaaaggagataattggcttcatatcctgccccaaaccttactggctggtgacctttgagcagattgcttctgagagtccagtgccaccacagctctgtgtctcttttgtcaaatgtagatcaaggaccagatatggtggctcacgcctgtaatcccagcactttgggaggccaaggcgggtgaatcacctgaggtcaggagttcgaaactagcctggccaacatggtgaaactccgtctctactaaaaatacaaaaattagccgggcatggtggtgcacacttgtaatcctagctccttgggaggctgaggcaggagaatcgcttgaacccgggagacggaggttgcagtgagccaagatcgctccactgcactccagcctgagcagcagagtgaaactccgtctcaaaaaaaaaaaaaaaaaaaaaattaaactctcggtacttcagccataaaaaaggaacgagatcatgtcctttgcagagatacggatggaactgaaggccatcatccttagcagactaacgcaggaccagaaaaccaaatactgcatgttcttacttacaagtgggagctaaatgatgagaacacatggacccaaagggggaacaacacatactggggcctgttggagggtggagggtgggaggagggacaggagcaggggaaaataactaataggtgctaggcttagtatctgggtgacaaaataatctgtacaacaaaccctcaagacatgggtttacctatacaacaaatctgcacttgtaacccctgaacttaaaagttaaaaactctccatcctctcattcctaaagtgctgaagtgaggctcagatgcaaagacggttgtgagtgagtgctccttccacagtgtgaaacacttgacaaatgcaagggattaatcctatgatctgtatcctccttggttccctctctgggctgggctgtgatcacgtattccaagctgctgttgactgagtgctgacctcgggtcagggcctgtcccagaggtctttcacacattctgtgcacacttgtccagtaaccctcacagcactgtgagaagaagggattacctttgttttatgaaaaagaaaagtgaggttcagagaggtgatgtggtttacctgaggtcacacagctgtaaactgcagagcttgggatttgaatccagacatggttccaaaacatgtcttttctcttcattcccagcttattggctcccaggttaccaccttattctccccctactccgttttgggcagggtgttgaggcaggttatgcagggatgctggcttcagaggactactggcctccttgtcaagtcattttgctattttcacaaggacaagggcaaccatttgttgagcatctaccatgcatctggcattgagctggctgctttagatctgttattttcccacattaaatcctcacccaaaatctatgatgtagaaaaaaccactctcattttagaaagggacactgagctgggcgcggtggctcacacctgtaatcccagtgctttggaaagctcaggtaggaggatcacttgagtccaggagttatagaccggcctgggcaacatagggagaccctggctctacaaaaagctacaaaattaggcaggcctggtggtgcatgcctgtagtcccagctacctgggaggctgagtggaaggatcgcttaagccctggaagttgaggctgcagtgggtcaagattgcgccactgcactctagcatgggagacagagtgacaccctgtctcgaggaaaaaaaaaaggagaccaaggcttggagtggttatgtgacctgctcaaccgcatgcaattagtaaacaagcagccaagctgaaattccacccaagtgggtctgatcccagaagctggctatttccctggcttctccttcgtggccctgaatatccagccccagttggggaggggtgacctgtggctcctgggtccaacacactgggtctgtctgcaatagctgccgtggagacgtccccgcggtgcatcatgacctctggggctctccttccccagagccccgtgggccctgcccttggtgcctggcacactattactgcctgggaaacgctgaagaatgatgacagggctgtaagcctggcttctccaagtttctgcttgacctccaagggaccagaggaggagcggggagagcagggagtggagtggctgccgacatccacagctgatgcagggactcgtgtgtgcctgggcctccctctgaaagctgcctttggaaggtggtcacagccagtctgctcacgcccccagtcacgccacctattagcctggctgccctgggcacagtgacctctcccaggctggcgtcccctcccagggtgagtccatcaccaccagtcacagccgagctcctgtgcttggctttcaaggcccctcgcatctgcctcaagcctccctgtctttccagcctcctctattgcttattcatttatttaaaaaatatttgttgatcaactatgtgcctggcagatgttctaggtcctgaaaatacagcagagaacagaacagataaaatctctgctcttctgggaaaaattgacagaaagcaagttgacgaataaatgtatgatgttgggtagtgaaagggacttataaaaaaaaaaaaaaaagaaccagaccctccccctgccccaaggcatctagagatagaattcagggggtcagtgaagttagaggaggaaaaaaattatatttttatctcactaacctgtaactaaaatatcgcatttttcttcaattataaatgttggcaacataccacggtagtattagcagtgcctgtgactttgtcaccaacagaaatcagatatttcctatcacattacagttgttgcatacattttgaaacatcattgacactcatcactgcttcaaaattgttgtggttaatagaactgccacgagatcttgttatttaatgcattaataaagaagtgcatctagtactgtatcactcatttgttttgtaaatattttgaaaacgatttctatataattggctgccttgataaatctatgtattttcgtctatgcctttaaaatcattattctgagaagggcttcaccagggccaaggggtccatggccccagatgcattaactcctggagtggagatggatggggaggaggggcgggtttttagctggagtggtcaaggaagcctctccggggaggtggtatttgatcagcaacataaagtgggcaaaggagctgccatgcgaagatttgagtcaaattcattgcaggcagagggaacagcaagtctaagggctctggggtaagaaggaacaatgaggccaaggtggctggaacaaagtgaccagcgaagggagaagacagagaggcgcatggaccacacatgatgtaaggtctggctttggtgaggactcgggattgtattcccagcaaggtgggatgctacggaagggttctgagtcaggcgtgatgcattcagatttctcaattagaaggatccctttggctgtggggcagagaatggggcactgagtagtgggtaggaggggaagcaggaagaccaggagctaggggtctgcagcatccagtgaaagatcacgtggcttggagcaggctgagactggagaagtggccccattcaggatgcatcttgagactggagcctgcagagcttatgaggaactaaaagagccattaactttcacccttctgctttggcttatgccactcctggaactcgctttcctgccatctccatcctccagccagctctctccctggattcttcacccatgtggcaaaaactgctagtagcctcctctttttccatttccttactaatagcccccaatattacctgggggagcaatgtgcccagctcagaggccaattctcccagcctcctctgcagtgacgggttgctttggagatactggagctgtcatctggtggggtttccaggaacaggctttttataggaagctgactccttcttttgcccctctttttcctccctggaacatgaacaggatggttgaaggtcactttccccaaaagcattttgggaccatgaggaaatcacagtgaccttgaccctgatattcttgatatcaaggtggggctttatggagtcaaaaaattctaattaggttttgttattagcagtagaataaaattcccaccgggtacaactacaaatttaactgcttattggacatctccctcagaataacatagccccccagactcattgtgtctaattccgggtctgccgtctttgtctcaagtaatttcttttcggggaatccatatatctgtaagaaaagagaactaataggccgggggcggtggctcacacctgtaatcccagcactttgggaggctgaggcgggcagatccgaggtcaggagatcgagaccatcctggctaacacggtgaaatcccatctctactaaaaatacaaaaaattagctgggcgtggtggcgggcacctgtagtcccagctactcgggaggctgaggcaggagaatggcatgaacccgggaggcggaggttgcagtgagcagagatagcgccactgcagtccagcctgggcaaaagagcgagactccatctcaaaaaaaaaagaaaagagaactaatagtttaagagctgcgtctatttacccatctaccactgaccctcccacccacccatccttcatccacttctgttcatctgggcatgcatccattcaacatgcttttattgagcacctactatgcactgggccccgtgctagatggggggctggaggtatgaataacatattttttttttgagtctcactctgttgccaaggctggagtgcaatggtttgatcttggctcactgcagcctctgcctcccaggttcaagcaattctcttgcctcagcctcctcagtagctgggttacaggcgtgtgccaccacacccagctaatttttgtattttttagtagagacgggggttttgccatattggccaggctggtcttgaactcctgacctcaagtgatcaacctgcctcggcctcccaaagtgctgggattacaggcgtgagccaccgcactcggccaatatatcttattttaggcccatctgtgtctatataagcagaatatctctagaagaatccaccagatgctgggaactaggagtgcccctatggagggaaactcagcaccaggacacatgggtttttattccttttgaatcttctgaattctgtatcatgtgtatgttttcaccctctaaatgtttttaattaacaatatatgtacatctcattcggatcttcagaatttgccttgctcctgaaaggatttgaggcagcttgttagaatacacagagatgaatagacgcagccctgctgtcagggagctaacagtctcgtgggtaagagagatgaataaacaattccaatacagcgttgcaggaggggcagaggggtgcagacaacaggccacttggcatgctcttgagggatcatggggctgcactcagccactgcccctgagtaatgacctgacacggccaccttctccttgcccccgtctgggcttgaaaaccaagatgttcacatttggaacatacatgatggagacacccccgtccctccctgcccactcccaagttcaggcacttgtgctgagctgacccctaagtcaccaagcaccacagtgcccctgtgcccacatgtccaggtcgggggtggctgcagtagcacggcgtgttgtctctgtgtttctgcttgccctgcggatgaacgcacagagcgcatgagggaggctgtctccagcgccctgatgtccagcacagctacaaccccttttgcagcctcaggctgggaagtggggatgggggctgagggagggcaggagctgggatggcatggcggggacggcggagaggaccagccacgctgcttggagaatgtggtcttttcagagcagccctttgaaatcgagcaagaataactttaaacaataagatgcttctctctccccctcagttgttgcccaggcaacgccagagtgctcaacaactgtttagttttttaagaaaccaaatctccctccctttggtcagctaccgccaggaagatgaagaggcggtggcgctgccccttgcggcccattgtgttggacccgggtcagccgcctgcagcagtgacatttaaatctgatgctacatattatatatgaaccccgagccgcactccttcacgacttgtgctccctaaccggggaggcttcaatctcccaccccagacttcttgcccgcttgtggctctggcagtcctggggagtcacagctgagaggctgacctctgcctggcaaagcagctgggagctgaggaggacattgggtggtgatccgtccccaaccctctgcatcacggacccatgagagccctcatcaagccagcagtcacctcatccacccaggcagtgtttaacccccagcagctctgctaaactgtttttgaggggccttgacctctgcaccagcagctcacctgttttacatttgcctgctcaaaaggcagattggtgccctttatctctgtagggtcttccacaatccagcaagagacgttttttgttatccccagttacagataaagcagcccaggtgcagagagctctgaaagctgactacgagatgtcaggcacttccaaacggaagccctgatggccgcccacggagccaggtgctacctcaagcccattcctccagaagtggaaactgaggttccaggggttaaagtgatgaccagtgggtatggcaggatttggacctgggccagcccaactgcagggccttgcgtctcatcctacactgccttggtgagaccctgtgactcaaggacagatgggcagatctctcctggctcccaggcttggccagtgtgccctcctagagtggggatcggtgccccacttcgcctctaaggaaggaacatgataaactttggcaacatgaagttctgggttgtgtgtccttaggcaagttcaaagaaggtatttaaatcctcactttgcttatctgtagaatggggacggtctccagctggcagcactgttgtgaagaagcaagtaatgacagctgccccgtagagagagctgacatgttttgggcagtgtctaaccactccgtttaatcatcacagtgactccagactcaggtcctatgatcatctccattttcagatgaagaaacagacaccccgggaggtggagtcacatggctagaaactaaagccaacgaacataacccacagggacaggtcctggcacatagtaggttcaaagcggacattggctgtcttctcctaggaagataaatagaggggattctgtctcctgggaaacaaaacctgggagaaaggtaaatttagaaaaacgaaaccaggttagcgcaagccccttatccagctcggcagcacagtcaggatgggaaattggcttcagacacaacaaaaactagaaggggaagtctcgacatttgtgaaatgagagagcaggggtaggggaggccagggccctggactctgaggagggatctgctcttccctacccagggcttgaagggctgcacgaggggggacgccaccagcagaggctggggcagggccggttccaggcccagacggggtgagggagtcccacacctgagacagatggccttgccccatctgggaatccctggaggttgtgccgagtccctagcagtgacaggaaacacaggcagatgacaagctgccaaggtgcagggatcacatttcctagctgatgcttccgccccatctcctagggccctttctctcccaggaaactggtggacactcatcctccagttcccacctccccctgcagaaggctcctgtccccgcgtccccccttcctgcccccgccagcgcatctcgtttagcaccgctaaatggcaagcccagaggtacaatgtcggaaggggctggggtaatgaactcccattggcttccttcacgagatcactgccttaatttacgaggcctgagtgagtctcatttccccagtgcacgttgagtaattaactattaataaaagcattactgagttaaccatgggggcatgtttaattcatggggcagcccaggaacaggatgggaggcttgggctcagtgggggattcctcgcaaagcaaaatattgccagcaggatgccgccaggccctgggccccctacagtgggccaccttttctgtccctagccagagtaacctaatctcaggagggtagtgaggctgcctgccatcccaaccacagggctgctgagctctgggaggtgtaagcccctgctgggctatagggctgtctgcttggtggctaaagagctgagtgaccttgggcaagtcacttggcctctctgagcctgtttcatatctggaaagcaggggctgttcagaaccaacagcttcccagggtggattgcaggactaaggagctcaagcatggaaaaggatgtggtaaatgacccaatgctctttactcgcatgaaattattttaggacctccctcttccccctcctcatgctagagataccactgttgactgttagggggcggggagaggatctacttacttgttcaaaataacatgatggaacaatcctatcaggatacctcctcttttcaaagatggatcagtagccccgctccccctcctctttccccatgtgcacctctggccagccacgggtgaacaaattgttacagcagccaaacacaccaacctcaagctcacgcacatctctgcaccttcgcatctgctttccccttgcaaggtacgcctcttttgtctgcttagcaaacttctatttagtcttcaagactcaattcaaaagggtcagctcttcctggaagtctgctctcctcctgacccagacggttgctccctttcctgtggctcccatacattcaactattatggcatctgtccatccaccatccatccatcatccatctacccatccatccacctatccatctaccatccattcatccatcatccatccatccatccatccacccacccattcatccatccatcatatatctacccatccatccatcaacctatccatctatccatccattatccatctctccatccatccatccatccatccttcatccatctacccctccatccatctacctaactgtccatccacccatccagccatccaccaacccatccatcgattatccatccatccgtccttttatatttgttgaacaactaccatgtacatctctgatcacacggttttgaatgagtctggctttccatagaccaatgattcttaatcttttgggggtcaaggacactgtctcccagaaaaacatgtaaatgcacacacatgctggatgctgctttcctcttcagagatccctggtcatccctgaagccagactgtggaccctggttgtggtagacactgtgatgtggtgttcaggtctccggttgggagtgaaggacttatttcctcagttgctgggagtccggcagtcatccttctttggggtttgtcttgaagaaactgccttacccaaagtcacatctccttccaggggcaggctcacttccaatgacaggtcaatgctgtggtgtaaggccatgagcctctcaccccaactcgggacaactctgaaaggtatctcagctttagagttccccatggggttggctgaggcttttggtaggactgccttgaagctcaacttcccctctgccctaacctgccgccttctcctttccacaggtaatttttccaagaccactttctaataaatgtcctgcactctaatctccatctctgaatctaattcccagggaatccactggattaaaaagccctgcagaagccaggcatggtggcacaagcctgcagtcccagcaactcaggaggctaaggtgggaggatcacttgagcccaggaggtcaaggtagcagtaagctatgattgtgccactgcactccaccctggaagacagaggaagaccccatctctaataaataaaataaaataaaataaaataaaataaaataaaataaaaagccctacagaagttccttgaggacagagaccatgttttaatgacttcgatatctccagcagcgatcaccggccagggcacattgtagactgtccagaaacactgatggaatgcatttgaatgcattttcctctggttctatgttctgtccttctgttgttccccagcaggagagttctcatctgacatccagaagaggacggccccaccagcaggatggtggtgggactgggagatgctggcctgtttctgggaagtatgttagttgccaacgaaactaaataaccatgggaacagacgttaagctaattggttactacaaagcaggggtgaagggacgtggctgatgtcagggctgtgcagttagggtgaaaactccatgggatggctgggagaccggaggctggcaggaatgggcggtggtgggagggagcagccccttcttacagggcaagtcatttggaagttagaacctgtaaaatccccactttagtttccgctagtggaaattccttcaaaaaacaagcatctgggccgggtgcgatggctcacacctgtaatcccagcactttgggaggtcaaggcaggtggattacctgaggtcaggagttcaagaccggcctggccaacatgtactgaaatacaaaaatacaaaatactaaaaatacaaaaaatgctgtggcgtaaagccatgaacctctcaccccaacttgggacaactctgaaaggcatctcagctttagagctccctgtactaaacatacaaaaaattagccaggcatggtggtgggtgcctgtaatcccagctacttgggaagctgagacaggagaatcacttgaacccgggaggtggaggttgcagcgagccaagatcgtgccattgcactccagcctgggcaataagagcaaaaactccatgtcaaaaaaaaaaaaaaaaaagcatctgttaagtgcatgctcagtaccagacactgcagcagagatggggatcttggaaggccagagctccaacgctggctcctcctctcatctgggcgagttatgtgacgtccttcctgctccatttcctgagtggtgatgactatgagccgagcactgtgtgctttacctacattattttatttcaccttcacagtagcttccttcaggtgtatgtattattattccttctgtagagacaaggaaacaggctcggagaagatcagcaacgtgtccaaaagcacgcagctaatcacagcaaagagagacacgtctctcactctacggcgtctgcaggttgtatccttagccatcgttatgcttaaccacttggaacttagtttccacagctaggaaagaaatacaatcagtccttactgcaccgggctgttacagattaaataacctatggcaaaggcctagatggtgcccagtgaacggtcttttctgttctttcttccccattccccagcccactgcctcatcactttcctgggctgggaggaaggctgactccaaaaatgaatgtctctgtccccaagtccggcagtgtctgccatgtagccagtactcactgaatgctgtcgacctaaatggatggcctgggagtccccaccctcagtccatcactagtgtgtgatgcaggaagctgcagcaagtaccatgaggagaattctcttggtgccatgtaactactctcaagccactgggattttcaggtttttcacagcaggataaagcagaaacagatggagacaatcccttgagccctcaaggcagaaaagggtaccggagtgaagatgaaggtatgccgggccctgcctgatggctcaggtccctcccacaggcaaactgcagcccattctcaccgccaccacaacaccaactgtggacgtcctcacatattggagccattaaccttccttccactgtgggcccctgggagaggtggtgggcaggtaagcacttgaaactcgaacctgcaggtcagtcctctctccgccccttctgcagaagcctcggagctggggctgtgtggggacagacaccacagccttggagagacaagtcacatcctcagcttcccctcaacctgtgcaagcaccgcgttgccatggtgatgctgcagccctgagatgcaatggctgcagacagcatgggtggttctagggctcaatgccgaggtggacgctgtctggcctgggaggccaggcgattgggtgggctgggtgggggaggagagggagccctcctttaggttcagctggtaattgctgctaaatgaagggctgtcattgaacccaacatgtgcgaggtaagggcccccgctctgcaccttgtaattactgcaccagacagcaacgcttgctccctgtgctgggaggcgggcagtgggggagcagacaggaagctctcatccacctgagccagcggggctctggcagactccccctgccgcccaagcagcctgcatcccaagcagcctctaagacggaggaggccctggcccccctccttggctggctcttcccacatcatccagctggagcacgagcctcctttaatcttggcctctgagcttgcggaatccaaggggggcagaggtgcaggagccagataagaggccgcttccaagcgcccttggtgctccacctccgcctgctgagtctgtgctgggaatctgaattagaggcagatctcggtctgactcctgagcacggaggctctgagggcctcgggctagtcaccgccccctcctggcttcagtctcctgctgcagaagtggaagttggactcgagaattcttgagggttctcctgctggtaaacttcagccagcaagctggatcctacttttgtaaatggggtttcactgggacagccacaccctgggtctgtgtcatctatggctgcttttgtgctacgatggcagagtagctgcaacagacgccatatggtccccaaaccccaaatatttactatctggccctttacaggaagtttgcagacccatttttaaagtattaaagttctcctgggcttaaccgaacgagctttagtgactccaacctgatggaaacaattttagaacaagccctatccttgtccccacccatggatacccactgtcctcttccaagcaccccttttctgccggtgtctggatagccgtggcagggcagctgggctctgggagccagtgtggtgcaatggcgccacctgctgtgagtgcctaggagcacttcgcctggaaagctttgtccccaagggccgggggggtctcccatggcccgggaaccagtttacaggagtagactcagtccacagcacatcagagctggggtcttgccccctcccttcctcatttgagagaggcctgcagtctagagaagacgtgggacttggccaaggaggagtggaaagcccaagccccaggggcccatgaagttccaggaggctgtgtggatgtcacgtgcagcacgtgcacacacagacgtacacagacttggatgtgaacctcagcccggccacttaagcagctctttatcttttccaggctttagtctcttagttgttaaaaggattaaaagaaatgcttatataacatttaatctgttactaataatgactcaatcttcaaaaggactctgagatagacattatccccatttcacagattaaaaaactacggcacagacaggttaggtcatttgcttagggtcacacagctagtgacaaagccagtattcaaactaggctgtgaaaacatgtaaggtctccagaatgcagtactcagtaaacattcatttatttcctgccagcaggtgcagtggggccccactggggaggggactggtgttctaacaggagcgagaaaatgaaggaggcctggcttaagaccagacatttgaagaaggctccaggcagggaaaggaaaggagaggccaggcccacactgtcccctccctgcccccacgtctccagcaacacaaggcggccagtggaccgtgaaccatttatttccaaactataaagaaacctgctctctgagaaaagacactgcccaggtgatgaagctccagcccctggaggtccaaaacccagtccaaactcagtccctttagaaagctgctgtgccttggaaatgagtctcggctgtcagagcctgggaagtggtgggaagaaccagcccactcccctctcctgctgcgattccagcgcagcttgggcccagctctggccagtcccaggctggcctggtgctcgccccttgtgtgaccaggctctgaagggaggggcaaaagtcatgagtccctggcttggccccaccacctggtgactcccgtccacagctcccagctaccatgatgagccctggcggcttgagcacagtgagtgctggcagcaggctggggagtggcctgcttctaagccatttgccctggctggtcactgctgcccctgggccacaaagtactcctcctcctcattgtcaccttcctcccgctggctgctccggagcagcagctccaggtcggggctggagcccagccccttcaaggccttggggccaccatcaccttgggatagagagagaccacagttacaggcccagtcgtggttttcttggtttgctctgatttgcatgtgtgctgagtcacccaggccccacccacccactctggagatgacccccacatcttcctagaggagtgacggcagcagagccaccgggcacacttcctgcatcagaatcactaagagtcacagggagaagaacagaaaacagaggcttctggaagggactctgggttacctctggaatgcagggctttgagggcaacgtggagggatattcccgagaggcagagggcgaagcccagccagttcaggaggctgatctgatcgcccagcagatgagctgccaacagcaaagtgcagacttcctgggggcagagaagcaggagggagcatgatcaacaggcagatttggctgcttgaccaggagggtggaaggtgggggcactaggtacactcaggtgggcagatcaagatcttactgaaatcctgggcccaggcaggcagagaggtcaggggacccggccggcttgcggcgctgtcccgccagcctccttttgtgagatgcaacaaaggaggtgcttgtcatggaattctgtcaggaataaaagaggcaaaccagatcccaggctggggaccagggtgtccagatcgcgccttatccacaaggataaaggacggctgccccagaaggcagccacagaagagagccctgagcctatgtgtgagaatgctgtgttaccccggactgaagacacaactggtcccggggctctctataaacagagactccaaacaggactggcaaggccgttcatccaagaaccacagccatgcctcagcatgcggctggccaccagaagacccttggacaggcctgcatttctgggtttaggcaacactgcttcaacactggtgtgtgcctggccaaagagaaaagtccctccctgcccctgaacagggaggactgttgaaatgtgtgggagggagaaggagaagtgagaagaggtatgagagggaaggacaggcctgcgaggcagaggtacagcaaggctggccacaggggtgctttctcagggtctcactagccctggccatggccttggaggacaccgccagtcaatcacggaactctttcctgatgagtctggataggggctgttcaacctgtggctccaggccactgcccagtgccagagttggcagtcaaggtaaaatgtgaatgcattccaggcctagcagagtcagagctggctttgaggcccctgctgtgcccttggggaggggcggctctccatctgtgtccctgtctgtgggatgggagtgatcataccctctcacagggctgtggtcaaggcagaaggaggggccagcacagcactcagcaaagtgcctggcacctaatggggcacttccttctcttctctgcagggccctggggtgcaggagctgggactgaagctgctggtgagaaacccctgggggctccctctctaagacaggactggcatcacgcccgagtctgtaccttaaaaatgccggcaatggagagagtgaggctggaggttctggagaccaggaggaactcagagaagcccaaaccaaaggcgagaatcccgccaaggaagaggctcccaagtacccgcaggagcagccctgtgtcctggaaacggaagattttctcagatgtggacaaatggagacctgaaagcaacagggagagagagtgggaggccgggtcctgggctgccttggccagcccaatgccaaccacacaagatcttccactgtagtagtgagttcttactgagacctgctaactgtctgcagcccagagaaaaagcatggaaggtataaagtgatcccacacagatggcctgagacctggggaaaccagggaagcagtgatggctgccagagcgcctgggggcaatacaagccagatcctagcaggatgatgcggatcctagcgggatgatgggaccctagcgggatgatggggatcctagcaggatgatgggatcctagcgggatgatggggatcctagcgggatgatgggatcctagcgggatgatgatgggatcctagcgggatgacgatgggatcctagcgggatgacgatgggatcctagcgggatgacgatgggatcctagtggaatgatggggatcctagtgggatgatgatgggatcctagcgggatgaaggagatcccagtgggatgaaggagatcctagcgggatgatggagatcctagtgggatgatggggatcctagcggaatgatggggagggctcgtctgagcctctggggtgaagtagaggggggtggccctgcatggaaagacggatggaagtgccctgcacctttggacagtattcccttactggtctgtggggaggggctcatggctgctgacttcatggggtctttggagctgtggtaactactgggctaaagaaggtagggcggctaccaagtgacgaaggaccaacagtgccccagcccactcagggaactccttggtctacatttcagccagttcacctacaaacagggacaaaattctatccctacaaacgttcattttaatctaggtcttgctagtacagagctgtgggacttgggctgagatgtgtcccctttctggacctcagtttccttactgataaaatgagaggcctgggaccagactggtatttctccaacccgtggtatcacttgatgaacatttcccaaaaagaaaatgcaaacacatggccccttgctccagaaacacaggcatgcacaccccctaccccaaattcagcttagactttcggaggagtcatggtccctccaacactgtccatctggaagaatgactcccggcgtccctcccacacgaaagtcctcgtggtgtattagcacagggtgaaggggggcccagaactgggcacaagagacaactgtggtagctggaagctggacgagtattttgagatttttggagggaagcaccaaagaaatgccgagtgacagtccccccaggcaaaacagcctcacagtgtaggacatcttgtttggtgctgggctcagcagaactgcaaaggcgtcggcaaattgaagggaattcggggaagagcagcataagtaatgaaggcgcttgggggattaatttaccagaaaagattaaaggagctaaatccatgcagctttgccaagtgacgactaccaggggctttcagatgaggttttgcagagatggggcatggtgtaaacacacgggaggggagggagagtgtggcgtttggtacaagggggcataatgaaggagtggggagagattttaaagaaggaaaaaaaacgaggccctgaacagaagtttcctggacaacggggcttcagaataattttcttggggaggttcaagacgcttcactgcttgaaacttaaatggatgtgggacagaattttctgtaatgaccctgagggcattacagacgggactctgggaggaaggataaacagaaaggggacaaaggctaatcccaaaacatcaaagaaaggaaggtggcgtcacacctcccagcctacacagttctccagggctctcctcatccctggaggacgacagtggaggaacaactgaccatgtccccaggctcctgtgtgctggctcctggtcttcagcccccagctctggaagcccaccctctgctgatcctgcgtggcccacactccttgaacacacatccccaggttatattcctggacatggctgaacctcctattcctacttccgagatgccttgctccctgcagcctgccaaaatcccactcaccctccaaaccacggcctgggaagcctttctgacttgcctgattactccagcatcttggaacaatccctgattccccattccttagaggcaagatagggtggttaagagtagggctggaccacttggagccaggctgctggcttcaaattctggctcatttacgagctatgggaccttgggcaagttatctttacttctctgggcctcattttgttctacctgcaaaatgggggataataatagtactgccacaccaggtttttggaaggatgaaatgagttcctatgtttaaaaagatcagaacagccctggtgcactttcagggctctgtgcacacttactgttactgttccctgaattttatatgtgctttctctgtagcgtttatcatgctggaccccaaaccatgcgcttccaggggagggactgcatctttgatctcaataatctctgcagctaccactgtgttgggctcagggcgaggatctgtggtctgctgcactgaggtgcccttgagagggaaggcccaacgtaccttcaaatacagcaaagagagggaagagccccaggaacatgagtggctgcaggtggaacatggtgtcgatgggattctggaggcctgcagggcgggggacaggcaccatcaggtctggtccggccctgccctgcctccgccctgcctgtgccggggttcctctctctggaggatgagtggcacgtgctcaccgagttcagccttctgcaggagcatctgggtgagggtccagcgaatgccaccgatgaacgaggcccccagcaccaaggcgaagccctccacgttgaactgtgtggacttgtaggtgaacatgaagagacccccggcgatgaggaggaccaccaggaccagtgccgcgcgctggtaggatggggagcagtggcagctaactcgggggtcttgagggtcaagggttcatcacatttggagcctggggtcagcagccatcttggctgcccctggggcaagaaatccttccacccttcagctccatcccagggggtcctggacagtccttgcccaccaatgtcagcatgtagggctgacggtcagctggtatgccaacagccctgcttgctctgccacactgacggctgtcctaggcccccaagtggtcccacctcctccctgggcctaacacacagggctactgcctcccacagcagggtgcttcctagacccagctctgctgggaccctcatcctgcagtgctttcacctttggtcattaccctgccacactggtttctaaatattctgagtattgcccatgtctaggtcccttctcagaaagggatctactgccacctggactgggcttgtctcctctgtcacacagcaggacaagccactgctcagactcccactttattcttagcatctgtgggggcaggaaggacacaagagacgctggggcctcaccagctcctccagcttgaagatcagagagaagatcaagatgaagaggacagctgaggatttggtcattgtgtacctggaagcaaaattacccacaatgcactgctggagctcagggctcagacccatcaccgagaaaggagcaggagcacaaatcactgagcgaaatgaccaaacagagctgggctgtcatctgagtgataagcgacctttaatcagaaggaatctctgactaagaggcctctggttatcaccagagagaagaggttacaggtctgacgttgagctccctgagtcctgttctttacctaaccctcggcagagcccaggagcgggaaggaaggatgagaagtaggaggacaagaaggcaggaacagtgctctctgaagcaaaacatcagagggaagaagaaactcttgtgtagcccccaggccacatagggctctgctgcggctgcgtgtaccacccaccagtggccacctgtctgtggccttgcagcctgccttcccctgctctgatgatggggttctgggagagctccctggcttccccacgctgcctggcaggtgggcacagcatctcctctgcgctgggcttacggaagaggctggcgacttcccggagagctgctgggtgccagggagaggctgagagagcaagggctggtcccagagtggtggagtggctggcctagcagccgggtgtgcagacaccccgctggacagacagacagcttcagcctgaagggaggcagcagggcatggccagtactcacagcgagacggtgacatacaggaagctccagttggacaagcccacgtcaagcgccgtcgccagagctgtgaagacacaggcacccacaggacagcttgggaggtccacactctgctggggtgggctggtaccctgaggcacctgagtgtcccccacttctgaaccatcccggtgcctcctgtggggcccttgggccttcttttccaccagcaactaaagggttaatatctggcccccaaaggtcgggggctgctctagcattagggctggggcccattccaactggctgggccggtatggtttccacaaacactccggcgagccccctgagcggaggtattaacctgatctggttgatcccttactggaaacccttttccctcaggatggaacacaaactcctccacggggaatccggcctccaggacatgacccctgcccaccctctcagttctcatttttcccacttcctctggccagcaccgggttctcagtatcctgaaacactttgagttcccttccagaccccacagctggcactaaatctccctcgggccacgagggcccctcctcccagggccaaccagtcccacgcatccttcagggctctgcctacttggcacctggcctaggaaatcttcctctaccagccatgggccccggccttgggttggtcccctccctgggctccgtagtgccctccatgtccgtgtcacagccctgcgagggcagggaccctgcctgctcaccacttatctccaggcctgagggctgcactccaggctcggtgtctgctggcaggagagggagctgcggggccgcaggtgcagggggggttttgtgggtgtgtggtggggcagtgggaaggcacgcagtgcacaagaggcagcagcgtgggtggtgggaggccaggtcaagagggcagaggaggaacagtgcaggaagaggggagggacttggcttccagacatgcgggtgtctctcttgttctcatcctatggttccccagcccctcttcctgctctgccctcactgaggtcccccacctacctgtgggagccactcttctgaggtagtcggcccagctcagcaccacacgggccctgtggctggagcactgaaccagcgccctggacagggcggagaagaggaagatcacggccaggtgcagcatcgtcatgaagagggggaaatggaagctctgtatggagcccaaagcagacaccccggcttggtttagacagcctgccccccaccggctccctcttcctcttcgcccctctgctggagtggggctcattcggtggttcatgaggaccttgctatgtgtgtagggcccttagttacggtatcatcgcttggaatgacagactcttaggtcacgaagacaggtggcagccaagagactcaatcctagcctggtgctgtctccaccatttcaacacacctgtgagctacctgcccagccttcctcacggcctatgcccaagtgagagccactgcggcccactacgttgtatcacttattaaaatattgaaatacttctctagtggggtaaatagctgctgcttgagccccagtttccccagctcatcccttcacaccccccgctctccttggtttccctggatccaaacactgaaggggaaccctggcacggcaggcttggagggccctgttccagcccagccgtgactggcttccagttagactggttgaagcttgtgccttcctgttaaacatgaagggcaccgtagccatggctctggccaccttcatcccagcaccccgccccagcaaggcctcctggtacctttgtcagccacttgttgtagaaggtgatgccgatggagaagcagtagtagagaagcaccagccccagggtcaacaccgccttccacaaaaaggccacatcgagggcccacctccccattcgtggcggctgcagcaccggagctcctgagtcagcgggggcaggcacccctcttgaatacaatgtgcaggaagagccggtggagttagaccacagctttcaccaagaacgtctccaggctggaggagctctctgcagctccatgattcggaaccatcagcagagccccaggcagagtcctcacctaaggggctggtggctggtgctgacccttcccatggttaattggatgcagcgctcacaggtcccaaggtctgctgctggggaaaaagggccgctctggagcctcaggcagagactgtgcttctcgtagccatgggtgcctctgaaggctgcgtgactcagggctctggaggggctgcccacaacggcacaggcagtcccagagacccacgtcgtgtctgctgtcttgtcacctcaagctattctccatgaactgccaccaaagtgaccttttaaaacacaaactgatcatgtcaggccactgcttaaaacccttcagcagcttccagtgcttttctgataaagaccagcacccttctttcggctcccatggcctcatctggccctgctggtcttcccagtctcagccacaggctctccaggacctggccccactgggcgcctttcagctccccaaacacaccagctttcttcccgttgtctgaaggaaatgaacgaacactgcacccacccttcagtccttcatcaatcctacctatcttcagctcagaggtcacttcttcagggaaccccaccccatcccctgaatcagtcccctgagatacatgttgctttcacggctctcctacttctctttcatagcacttgtgcagggtgtgatttgagtaatgtctgtcccctgagaggctacgagcggcacaaagatagggaccagtaagaccacactggccttacgcacagctggtgtactttaagttctccgtctggtttgatgactgacagagagcaggcatgcgattttcaggggactggtctggtctttaggggttaaaaatggagaaggaaaccaacactctaacggctggaacactgtaagaccaggctgtaaccactactccctggaagcagagcctgccttacggtattgccaaatgaaaccactcccagcctccctgtcaatccagccaaccctgatgagtgcccggagcatgccgggtagacctgtctgtgcctggaggagcctcaggtccagtgttatgtgatgatacctgctgcttcatctgggtgcccccctcaaccacagatcctcctttgagacattcccatcctattgaaacgccaccttcttctcgaagccttcctaggcttcacgatcagacacattctccatctcccaccccaacatttctgaagggagcagttacattccattctgcactctggaactcttgttactatttcccctccccggggcaaacagggagctggctgtgtccaaatgaatctctggggctacagttgtcttcagaggagctttggaaacctgtggcggtattttggggatatgctcctggcgttcagtaagcagggataaagaaggggcagtccacatagccaattactgctctgcatcccgcacgactttgacatccatataggtgaaagattagcttataattatctgaacctagaatgtaactctgtttacatgtaaacacagtgcagtgtttccatggttctgctgtgaactaacacttccaagaataagacgcctatgtacaatgaagggagactgaaaatggtcaaaattggtctcaaaatggcaccaaaagtgtccattctggaaaaaccacatcatctacagcaatggcactagtggttttcgaggtgcgacacaacacggctgtgtcagtctgtgtctgtggccatcacactcctagagggtccacacagaagggacagcttcactgcaacttccagcactattgtgcccagaaacttacatattgaaacatattttgttttactatcaattactttccttttatgttatagggcatggttatttatattttattttattttttttttgagacgaagtttcgctcctgttgcccaggctggagtgcaatggtataatctcggctcaccacaagctccgcctcccaggttcaagcgattctcctgcctcaggctccctagtagctgggactgattacaggcatgcaccaccacacccggctaattttttatatttttagtagagatggggtttctccatgttggtcaggctggtcttgaactcccaacctcaggtgatccgcccgccttgcctcccaaagtgctgggattacaggcgtgagccaccgcgcccggctgcatttgttgatttttaaaaaattatgtgtaggcagtttttattaatcatatgtttcattttagggtaataaaagggactgttacaaaatatttgtaataaaaaagaggtgtcagatccaatgagttgagactcctacctgacctaatgcattctcattccttcaaatgccttctgtaagctgatgtcttcccaatatatgccccggctctgattcatgtgaactccagaagaatatccaatgcctacctaacctcttcttcccttagatatctaatatcaggcatctcactcacatctagagtgtctgaaactgactcgtgttttccacacccccatttcatccaagcctgctcctcttcctacttcccatcccagcaaatggctccactactctcctagttgctcaggccaaaagccttaggctcatctgattcctctcttccccttagcccacattcaatcaataaataccgtcagctctatcttcagaaatatcccaaatatgagcacatgtcctgaactccaccactaccatctcagccaccatcctctccccaaatgactgcaggagtctcctacacggttctctctacttctcctgcaaccaccaccatcaggctcctccaacaaagagggcgcatgggcctcaaacatacgtctacagatctcaaaacccacactgtttcctctacgccagggtttctcaacctgggcgttactgctgtttggggacagataattctttgtgagaagacccatcctctacatggcaggatgtttagcaacatccctggcccatacccaccagacacctgtcacatccttccccccatcccaagttgtgatacccaagaaatgtctctagacactgccatatgtcacctgaggatcaaacctgctccctgttgagaaccactgctgaccctgtcctgtgacaggcactcacaggacatgctggcactaacagagctttcttctgagcactcttccctcatggctcctcctgtggcttccaagccagggaagtctgttcactcttctgttaaccaacttcttgcagctcctgcttttgctgcatttcctgctgcagcactgcaacaccgcaacaccctccctccactgttcaaatgctgaccttccttcacagacctggcccagttcccctgcctccaataagtccctatggctaccccgcctacaagaagcactgtctcaaatttaacttattttcttattgggattcagaaggtcacctatgcccaaacacaaagccaaatctcagctagaagggtccctggagatcatctaggcacttaatgagcatttatcaagcactcctgtaggcccaccactggagacacagacgtgaaactgaaaaggtccccacccttattttataagggaaacaagatttaaaggagtaaacaactctttttgaaatctcatttgctcaggaaggaaagtccatattctgccccactttccacagagagcagcttagctgggggcagcagtcacatcaaggtaaggctggctggtgcatcactggcacacctgcttccctccatcttcctaactgtaacttgggcagcatggtttagtgcttaagagtgtgggctttggagttagacactgagaatcaaatcctggtgtccctactcactactgtgtgaccctaagttacttgacctctggactcagtttctccaactgtaaagtggcatcaggtacagcattaaatgctggctcatggtagaggcttactcccctcctggtccccttaacagtgaaacttccccagaggaccccgcactgccagtccaactccttcaccccctgctctcacttcagcccatctccactgctccaatgagtcaccacaccctcctccctgctgccccttcgaaggcttagtctctattctttttgttgttgttgttgttttgagatggagtttcaaggctggagtgcaatggcgtgatctcggctcaccgcaaactccgcctcacgggttcaagtgattctcccgcctcaggctcccgaggagctgggaatacaggcatgtgccaccatgcccggctaattttgtatttttagtggagacagggtttctccatgttggtcaggctggtctcgaactcccggcctcaggtgatctgcccgccttggcctcccaaagttctgggattacaggcgtgagccaccgtgccgggccggcttagtctctattcttaccttacacaatggatcacttcctcctcctagaaaaaaccttctcttgggtgccacgataccacattctcctggtttttcttctgcttttctggactccttattggtcttttttgctggcaccttcttgtcaactcaatctataaaaattgggtgcctaaagcttggaacctggcttctcttctctcttaaatcttaccctacataatctcatcctacccaatccacttgccaatgatttctaaattctttacatcagccctgaccttttctgtatcagactcatatatctaactgcctatttggtagctgcactccaaatatctaaaacttaagatgccctaagaagatttcgtaattatttctcacgctcccaatctatcccaaagtcatttagtaaatgccagcataatacacttggttacttaagccaaaaccaaaaatctatgatgaagtcatctttgaccacttatttctgtcatttctcaaatcctgccctgtcagttccactttcaatacacttcttgacccctctacttctcttcctctccattcccactaccacagtctaagccacaattatctttcacctgctgactgccactggtctaactggtctccctgtttcctctttcgcccctaaggcctggaatctataaagcagccagagagatggcacacgaaacagatcatgccctaaggctaagcccagctcctcagcctggtccacaaggaaggcctctgtaacctcattcttctgccactggtcccagcacccgccacagcggccccctgccacgtgtcaaacacatcaaacctgtgtttttctttacttgctgctcttcctgccttcagctcccttccgcagacctccgcttggctgaatactttctccaatgccccacccctcccaatcctcgtggcactcccacctctgacgtttccttgtttgctcacgtgtttactgcccgccccaatcccaccgcgggaagcagcccctcagagggcagggccgtgtccgattccggcccgggtcccgcacccaggacgtcgcaggtgctcaggaaataccagatgagccggcgtccggcaggtgccttgcaggagggcgcttggagacccctgccccctccacagacggcgaaactgaggcccggggaggggcaggggcgtggcgtgccccatgtcaacccgcgcagatcccgggtggggagcccgcttcccttctccagccccggccccccagcctctgggagtgcgccgggaggccggccgcacacccactcacctcggccctgggagctccaggccggaatctccccaccggaagtgcgaggccggatgccgccgccgaaccgcggcacgggcggtaacttccgccggaagctacccaggggctgggcggagccggggcgaaaaggcggggcggggcagcacgggggcggggcgtctgttgtggtcgggttctgaggtggtctggtctttctgaggtacagcgtagttttgtcctccgcgaagtccctcaggctcagagcacagccgtgtaattgtctgcgtctctcccgcgctcaatcaggggcttgctttggaaccccggtgcctgctagtgttctgcatacagtgagcatccaaaaaatggtaacttgtttacttttactgaacaaattgtttttcttatgtccagtctaatgctgggcaaccatggaatgaaccacgaagataagtatctcatgggctttttcttctgggagctcaggccagctggggccattacaacttaaaacttgggcgatccagaagtaatacgaaacatttgtgaaatattttctgtatgaaactttctaagaattatctcaacttcaataggttgagtagggagagagcatcccagatagaggaaatgggagaatcctaaaggagggtgagaaagctccagccgtgcctggggctcacaggttgtttgtaactgtggtggttaaagtagccaagaggcaggttgcagtggccccaaaatgccagcctagggagttcagattttcttcatcttgcgggatggattaaaagggcagcatttgcagtcaagaacattaggccagggcaagctagggttgcacattcagacccagttttgtgcctttcgccctcctctagcctcctcctgggctctctggcagtaagaccagctgcaaacatggatccttacaagtgactcagctgggatccctggcccctctgaacagaaggctcaaggccagagtgtaagcagtgttttatgcaaactgcggctgtcaccgccgccagctggcatcatgcaggcattagttcattcagtgcttaccaagcacctacaatggtacccatcactgcccaaggtcttggctttattcagtcctcaggcttgtattgcatgcactttctatgccttttgaaagagcctgtcctcacacccttctctctcagaggcaagagatctattttcatcaccaccctcatttaagtctcccagctaccaaggccaaggtttggagcaacagcctaaaacaccagctggaaggctgggcactatgcacaggcaacacacagggtaaagagcgtgtcttctttgtaaggcacaagtactcgagctgttccctggctgtgtccctggcagggagaagagggaggatgtgttcatgggggtgtacagtatgccttaccttgctgtacccagcagggttgagcagaaaacgcttcgtcccagtgcagcaatctgtgaacactcttaaccagcaggtgtgtgtctgtgtgtgtgtatgtgtgggaggagcgaatgatgaggaggaagggactcttggaaggtgactaagggctccagctggagctctccagagtctcccagatacatggagatcaagtcttgtcaaggtgaaatcttcaccattgggcagggggcaagtacagacaaacagctgttaacaggaaccacagtttgtacatgaaagagtatttattgaaaacatggttactgacaggaagctcctggctgctctctggttacaatcttggctcacaactggaagtgttacatactttttacttcccctcaattttatttttccccaaggttccatcctaagataggtagatcttatataaatatatatacacgtctgtataagtatggcctatagtaatgaaaatatatagtacactcttcattgggtagtacctaccatgccaggccaccaatactgaatgccaatgtgctaacgtatgtccagggagagaggctgtgtgtgtggtttacaagtgctgcagcaccagggaagccccactggcacaggtgtggcctcagccggcctcagccagctccctgaaatcatggccaatggcagaaaccatagcactaggaagggaaggccaacttcctggggtctggaaggccaaaggaaagcaaactggagggggctgcaattcaggttaggggagatttctctctgaggaaggaaaaggtattaatgtgggggaagagcagtagaatctagtgacctcaccacagtctaggcccaggcctcagctgggttttccctgcagcgttcctggagacttaagagggcaggacttggccaggaggtctttgacttgctgggatgagactgagcgcttgcagggagaaatttccgtctgctctgatatctgtatgggccagagagatctggtggctctaaagaccagagatgttagagccaacctcagaagcagcaacgtcttggcaccatatgaagctggagtgagccctcatcaaaaaagacaaaagcaaaagcctcaggcttgtactcagatctaagatacaggtagtcacttcaaggctctcaacacgcccaacacacctgtcctctgcaggcagcctttcctgggccagctgttgctcacgtggggatccagctgatcagagagcaggctcaggaggaaaaggtgagtggctgttgttaaatccatttcaagaagcagtttcttggactggaaggcaagggcatctgctgtttgttcctcgtggcccaatcccaggcttcatggtgatggagtgggcagagcaccctgccttcatgactcttagtagacagggaccaagaggaaactctgggtggtccgaggtgggtttgagaaatggctggcatttactggccaccaaaatcactacagattctgtacaagcaaaagacaaggcaccagaatgtaagtgtttctcctgggcccaaaatcccttctcctgggtaccgtcgtttctggctccaggctcagccatagtgatagacaaagtcatagctgctgggctccttggggatggggggtggggcttcgggaatctggatgttctccaggtccaggagccgcagcttcatctccatgctcagcagggtgtccaggtcactcttggtcagctcactggacatgtccttccccagaagggcactgaggccatcaatccagatgcagtactgtggggagcaagttgcaaaatgtcacatcgtgacccctggtcagcaggagatcctgccaaggtctcttttctgatggggctcacaacagttccttttggaactaatcagtataggcaaaactgatttggaatgatagcaaagataaattaggaggtgatccttcactttctcaagagatctggtttttataaggggttttatattacaactccttacaataatatgaaggagaacctaaaaatgcaataaacgaatacagcaaaatgagatctgagtactggggcatcatctacctgaagttacccaaaatcagaagcgagagaagggaaatatgtattaggtgaaaagaagcaagacacaaacagaagtcactgtgggatctcaattttgtgccccgcccccccgaaaacaaaattaaaaataatccagtcaatacatattaaagagtaaatactaaagaaatggaactggtgggtctcatgctaagagggggtgaccaggaagccttctgatcccaccgctccctgactcttcctgcttcctctgctgccattttcctttttccacaccgttgctcacctggttccccacttgcttgttcttcatttcctctcaaccaaattccactagcggcagctcaggccctgcccaagtgtctcctctgccagaagtcccacctctagttcccagtgatggctctcagagctcaccaggcacatagggtctcaaatgcaatcactcatttaatatctagtatcttccagtgctgcagatggaactacagggcccttgtcagaaggaccagttccatctggcttcaaagtccacactggatccattacaacatgtgaccaggagcccctaggaggaaggatctgtcaagttctcttgggtagctgaccacagagaaactgaaaaggggagaattttcccagtcccaggtaaatgactcattcctagttgaccttatctttgtaatgacaacctatggctgctgctgaagagtaatgtggagagcccagctcacagataaacaatccagagtgtgacagatccttggcagccacccaatgcgcctggaggaacctcaggtccagcattatgtaatgatacctgctgcttcatctgggtgcccccccaaccacagctcctcctttgagacattcccatcctattgaaatgccaccttcttctcaaagccttcctaggcttcaatatacactgcagccacccaccacaggggactttcctgttttgctcattcctgccaccaactgaagagttacagaaatagctctgttgtctaaggcagcgccacactgctcacctcatatttattaggtgcgatgaagtttaaggtctcatcagggtcatacaggatggagaaggccaattccaacacctcctgaaggagaaagggtttaaattagagcgatggaacagcctggggtctgcacatcaagatcttggccaaagtcctagtgactcggcatcatcaccaaacatgctgattcagatgaatgtcatcaatgctcctaggcggccacaagtgtggctggagatgaggcccagcataaatcaaccttaacttacccactccctgcccaagtcacatcaaagatgttgtgatatttttaagattggaaaaaagtcattttcaacactcagaaccctggaaggtcacgatccatgactgtaagttatcctaaaagtttttatattaccaagatgactaacaacttctatcgtgctgtatttggcataggaatgtcttaacaattaaaaaacaaaacaaaacacacacacacacaaaattggtcactgttgcatgataccaaggaactaactcattattttgaaagtaagtacataaaagaagaatcagcatttattctcgtttcctatataaactgtaccactgggaaaccaatagtagataagggcaagtttcatggttcagctcataaatgaaaagcaatgactgcatcaaaatatcatgagtttgcaaaccttagttgactgatggaatgaggcactgagcttcaacagtctgctaattatcacaaaaggagagaccaccagacgttatgtgcctcttgatagaacataataccactgatgacactggccaggaaaaaagttaaacctgaactggatcaaacctctagatccctcttccaatgtacagatctgggacagaggaacaagttaaactgtaccacggggaaacaatcagcaaaattcagatgctaggaaactaccaaacaagcaatctggttcttcagctaataaactgcaaaggaaaagatggtgggggatgggggggcgggggaacttatgaattaagaaacttaaaagaccagtcttagactctggtttagacaagatgggtatgggggtgtgtgtgtgtgtgtgtgtgtgtgtgtgtgtgtgtgtgtgtgtatccatataaacatttatatatctgtagagaaattatgacatttataagacaattggtagaaagtcaccatcagtggaatatttgatctgaaataactactttcatttcctgttatgtgtgctaatggactggtggcaatgttatacactatacgatgtacactaaatatttacagatgaaacagtgtgatacttgggactttcttcaaagcgataaaggagagaaacaagtggatgggcagaactggccatggttgctgagtctgggtgatgtgtatacagaggttccatctatttttgtgtatgttcaaaattcttaataaaacattcaggaatagagaggggaagatgccaagaatgcacctggaaaaaaccaccaccaatggcactctccaagtatcactgggccagctactcaaactggcctctctactcaccttgttctgtttcagagcacttttctctttcatgtggggacaatctttcccagtgacaatggccttaatgtctgcaacaggaactgataaatgatgggaattagtctctggaagttcatgctgcaagctggtcagtgcctacatcagtgctggaagggaggtactggggcagatgcataggaagcctcagccccaaactccaagggctgctgtatgagctcagtgagggtggtggggaggatggccttgtactgttccctccgtcttggtcactcctgtagaccacagcccagtgaggctgtgtcaaagctaactgagggtcacttcagggctcttggatttatatccccaaggaacgggaccttggtgactcccttcccctctccttcacaataatggcgatgatgatgccatcatcgccaacagcagtggcagctgctaacagttatgctgactacctgccaaccactcttctaagtgctttgcatacattactcatgcaatcctcttaggaggaaagtgtggctattattcccactttacaggagaagaaaccaaggcagaggggagaacttgcaattaattagaattcaagttaattaggagcaaagccaggatttgaatgtgggcagtctggcttcacagcttctcctcttaactactgcctttcgacttagtcatgtaccaccctttacagtctacacaatacattcacacctgtgaactcattgtttctccaaaccaccccaccgagtaggccaggtagaggaaatcgctgacagataaggaaacaggtccagagaggtaacaggtacaagcccagatgatcagctacaaacagctggactagaactcctgtctcctgacaagtccagcaaccatgacacatcaacagagaaatgaacctacttttctcctgcagggattcaaatgtcacctccccttgtgggttgtcatccaagtcaccatagtgaaggaccttgtggttcagtgccaaccggcagtaccagaaccgttctggaacacaagggaagccaaacaggtgagcaacgacagtactgggaaaggcctgggcacaaaaggggccatccaggcaggctcttcccggcaccaaggattgccccgtctcctctcaccttgccttcggcggttcccaatctttcggaagctgctgccctcacagagccggttcaggcgctgctgcttgatcagctcaaggatctcgggctggatcttctccctcagctccctggggtggacacacactggagtgagcggaaggtcatggggacagtggagctctggaaggaaagcagagctggcagccacctcccccgccagcctcccctgagatggaacttacacaattggcggggactggaagtcatcctgactcatcctctcagactggcgcagtcgtagaatctcagagtaactcaggctacgcaatttgctcttgaactgatccaaagagttgggtttggagggcaaagctcgagtgatttgctctcggacgacttgcataacctaagaggagaagaacccagccaactcacaccactactcttgagaaatggacaggcctattatggagcaccaaggctctttcctgccccagggtcttgagcagggcaggcactacagacatctgctgggtgagtaaggtataccttcttagatggttattcaggtcacatgactgacactgatagatgctttatttcccatatatttcaattggtcaatggtgtgggggaaatgagcatggatttttgtagtcagaaagaaatgggttcacatcttgactctgtcccttcagcaagtcacttaacatccttaggtgtgcatctactcatctctaaaccgagagaaaggaagacacatctcctgataggtgttgccataaagaatatgagataccagccggttgcagtagctcatgctttgggaggctgaggcaggcggatcacctgaggtcaggagtttgagaccagcctggccaacatggtgaaaccccgtctctactaaaaatacaaaaattagccaggtgtggtggctcacgcctgtagtcccagctactcaggaggctgaagtagaaggatcacttcaacctcggaggtggaggttgcagtgagccgagacagtgccactgcactccagcctgggtgacaagagtgaaactctgtctcaaaaaaacaaacaaaagaatagaaaggcaagcgcagttctggcacgctgtggtgttttaaaaaaatgcattggtccccttaaaacaactattaaagaaaacaacaggataccacactgcatgcgcagtatgatcttgctaatgaaggaaaaacctgtaggggataaaaaagactagaggaaaacaaaaatgtttgtcactggatggtgtaaatacaggtaactttttattctttatactttccaaattttttatgatgagatgatcaacttcaaaacactcgacccctagatgatcagcttttgagggcctggcacaacagtgctctgcatagagtgaggactgaaagcaccgagggataactatcgattaagtacccagggtgtgcacatcatgccagtccactcttctctcctaaccttcccagttcacaaaactacagcagtacctgcacagtaagcactcaataaaccacagtgagtcttctaatgcttatcctcctgacctctctggaggacgggagggacaggtgctaacttcaatggacaaatgagggcctacggcaccaagtggaagacaagctcaaggtcacagagggagcaacaaccagatggggctgaggctccccagtgcctcagtcttgtgactcagttctgcagaccaagctgcttttccagctcagggattctccaggtgccagccagctgtcaaaggctgtcgtgtgatggtctcctcccgtgggcctcagagcagcccggagacactgaccttgttgaagtcctctgctgttgccctcatctccttccaggtcttgttcaacagctggatgcagattccaaagagctcttcaaaggctcggtcatgggtaaagaacatcgggtggtagtcattgcgtccttcatttgctgtggaagtgaaaaaacagggagaagatgaagcctctgtccacaagggcctgggagctcatgtctggaaactttgcaccaaagtcccgaggaacaaaagcagcctaaggcgcgcaattaacagggagcgtgggatgggcgtttctcacgtccttagctttcttctccagggtgcattttcttgccttccctctaccctgttacagactcagccagcccttacccacaggcatggggtagctttggaatatgattcaaattgccagttcaaacaaagcaacaaccatgattcccataaataaggataagatggaattatcagctgatgcagtgatttaaaacaaaaaacaaaattaaaaacccacctaaggttgtctagtcccactgacatcttttttttttttttttttttaagatagagtctcactctgtcgcccaggctggaatgcagtggcatgactatgctcaccatagccttgacctcctgacacagtgatcctcctgcctcagcttcctgagtagttgggaccagaggcatgcactaccagttggctaatttttggttttttttttttttttttttttttttagagatggggtctcactatgttgcccagactggttttggactcctgggctcaagtgatcctcctgcctcagtctcccaaagtgctgagattacaggtgtgaaccaccacgcccgaccccactgacatgtaactgtttataattttgagtctcactgagctcttgatgacaaggaatggctgaagaagagggagctgcagagacttacgtagttccccaacctgcaggatttcacagagcattttggtgagctcaatggcactgcggccaaaggggcattcatgtttgtcttcccggctactgttctccaagacaatctgtcgggggaagagaaagggaggattagggagatgaaggaggaaggcaggagatgtggcaccaggactgagaaggccagctcccctgcctttacccggatgtaggtgtcctggtggactttagccaagtacagcatgttgtccaaggccagcattccaggaggagtctgggtaaagtccatggctggattgatgtggttctagagaaataaagacacccaatttgagatgcggcagtctccgtgtatgcagggacctgaggggatgccctctcgcctctcctcttgatgctgctaccactcagcacccacctctgtcctagctcttttcacacccatcaccaccactgaactgtgagctcttgagtgctggacggtggctgcctcaccatgcatcccagaacctacttcacatgctgctgcacactgagtaggtacgcaagaaatacttcttccagttaaccccatcctcaagccctactctatcacaaaatattcacactagctttgcaaagaacctagcagtttgggtaagaggacaggtcccctctctacccactctagctgaccgcaacccccctacagatggattcgtttcacagggccaaactttgcacataaactcacagactcaccatcaacaaagcaaagcaagcattaaagctccaccagcttcctaactgtcatctattccagggccaccatggggttggttgtcagagctctgtctgggtgggaccattgacttcccatcaggggagagggcctaccaccgtctatgctctgaggtacttacggtaaatcccagcattttgtagtcctttgtgtacatggctttgcgtttttcggtcccactcccaggggcattgctaggatcagactctgcgtcaaatgcaatcctcctcagttcaaatatgatgtccctttgagcctgcgaggtgaaacagacagtcagcaggtgaatcggctaaccaagggagcaaggaaaagaaacagtgggtcaggcttttctgggccaaactttggccccaatcaatcccttaggaggcatcacctctaccacagcaggacagaaatgggcttggctcatggtgcagatcatgctagattttctagggcagatgcaaactacttctgcagacaaagaccaagcacagtgcctggcacatagactaaggctggactgcaccacagccatgagaaaacagctgccccacttagcacctacctggtcattggggtccatcttggtcatcatcctttcttccagaaggttaaaggttaggacttgaaggacatatagctgatgggccatctcagttttgatggggcggttccctcggatcacatgctagaaaaagcacaggcagggagcaggggactgaactgatctcttttaatgaagggccacatccatgctaaggaaaaggaatgtatgttgggaagggaacagagctttcctcccacacacgaggacttcatattctagaaggcgatggagcatgaatgggcttggttcaggcagagatgactcactgcaggcctgaaaggcgccatcccttcctctgcattcccctgggcaggggaagcagagtgaaggcaggggctatacccaaccacaccagaaatgggggaggctactccatcaaggctatgatacagaacattgggggctggaccttcctccaatcaggcatttcacaggcctactaaatgcaaaacaatagatggtgtgcatggaggcagagttgtttttcccttagaaaaataaaatgttttggatggcttcacccagcagagaggctttgggaaaggccattttctttcaatgatactgagatagcaacacaaaggaggaacagttcactctcctaccagctccctcccacggccctctccttccttccttcctctcacttgtcctctcctctctcctatcactctgtccctgctccctgtgccgcccacaccatgtccctctccctcctgactctccctccccactgtctctgtgcccccacattcccctgtcggttcatcacctcctcctttgtccctctgatgcccacaccccactttaggtcccctggtcctgtctcatgttctgtctctgtctttctcttgcatgctatgtctccctcggtctgtcctagctgatcaacccttgattacattcctgtctctcaccatcctgtcctcactcccacaatatcctgcttcccttcttgctcccttgtatttgtcactccctctgtctcacccaccattatgaatcctgtccctcttggttctttcttgcccaaatgaggctctcctccattttccacatgtaccaccactatgtccttcaatttccctactcagtagctctgtctctagggctgtgctgtccagtatagcagccactagccatatgcagctatttgcatttaaatcagttaaaacaaatttaagttgaaaatttggttccttagttgcaccagccacattttaagtgcttagtagtcaccgtggctagcggctacagcaatgcagatacggaacacttccattaacagagttctactgaatagcaatgctctagagcgctctgactttagagaggtatctgactcagtatctttttaaagctccttctaactttggatcagctctccctagagtttgctctgactctagatcaatctctttagacctgtgaggtccagtttggtagcccccaggcccatgaaatgttaggccaaactgagaggtgctgtgagtgtaaatgcataccggatcttgaagccttagtaggaaaaaagaaaatgtaaaatgtcttattaataatatttcatatttattacttgttgaaatggtaacgttttcgatatcatgggctgaataaaatatattattgaacttaatgtccctattcctttttcatgctgctactaaaatgtttaaaatcatgtgcatggtttgggttctatgtccactggacggtcctgctctagacctcttcccctactgtgactccagtgctctctcctttttctagctgtttctctagatctacacttcctaatacagcagccatgagccacatacggatatttaaatttaaaatgaaattaaaattacaaattaggtcctcagccacaacagacttatttaaagtactacacatgactggtggccaccattgtggacagcacttccatagcacatgctaacatgctggagttaggcctctgcctgcatccctccctccccctgaatcggtgatcatgtccagtcctgtagctcccgccctgtcacaggcacgccctctgtctcttaagcgtgagatcgctcttcttagctcagtctcactgtttctttcatctctctagccttactctcttgttctctgctctgtgccccctgccccataacttcccttccttcccactccccccagtctctctcatggccaggggctcttccctgccatcgccacttcttttccccttcacacctcttcctttgcctcactctgaggttttcttctccactgctccctctctctaccttcgtctatcctattcctctctcctcactcttctccctaatttataaaacagctttgaatagaggtggaagttaatgtgattctgattttcattctctttaattctctttctccaacttaagaaacatcagggcaggaaggtaattaattatcctagcatcaatggcttaaagaagtacagctccagtctgatgagtgacagtttgaggttttacctgaagtctcacttgactgtcaagtatctcagggtcttagttctctggcttgactcagtgaaatccctggacttcagtgaccatgcattagccatttcctgccaggccacttaagtcctgagtcctgatgctgaactgccttctatagtgaaatctttacttgttcacaaggtttgtccagaaatgagttgaacttctaacccgattaaatagtaagtctcaaacataattaaatttccttcagaagggcgcactcatccccacacatgcagaagagggtgaccaggacagctgctcaggagtgtaggcaggaatgtgtgggaacctgtgtactcctgtcacttgtgggcttggggcccctcctgccaggctggtagctgggtgtgaccagggaagcagccagcagggagaagctggttctgcaaggtgaagtctggcagactctgcattttagagcagctgactgctcagcttcacaagtgctcagagcttacttcttcaatcctatcacctctgcatcctgttctgccaatacgagcaaagtgcttactgagtgccagacaccctgctaagcacagtattatattagctcacttagtcctcatatccagatgagcaaactgaagtccagagaagttatgtgaaatgctcaagatcaaagattggaaaatggcagactccaaagtccatgtttagcttaagtcttaaacttgacttctaatttttcattttattcccttcactgtggtctcccaggtttcccttgtttctgacagttgataaagttgcctcctttttttttgagacagagtttcgctcttgttgtccaggctagagcgcaatggcctggtctcggctcactgcaacctccacctcccgggtttcaagcaattctcctgcctcagcctcctgagtagctgggattacaggcgcctatcaccacgcccggctaatttttgtatttttagtaaagacaaggtttcaccatgtcggtcaggctggtctcgaactcctgacctcaggcaatccacccgcctcagcctcccaaaatgctgggattacaggtgtgagccaccacgtccggccaaagttgcctccttttaattcagatccttggctctcctcctccactcccaccggccccacctcccaacatcagccctactccaccccacaggtggtaacagggatttatacctctttccagatccccctgccagctcctgctctgctctcctccctcaggtaccccttagcaaacacatgtctttcatgtgctctttctaaaatgcaaatctggttacttcacaagctcaattaaatgccctcagctgtccttaggaatgagactaacctttcctgatctggtcctcgctacctctctagcctcctcatctacttgctccttgctctgtgcctaatcacacactccttctgggttctggctgccctctgactgaaattcctgttattcccggtctgcctactcatcctctaagggtcacctgaagacattcctctaaaagtttccggaaacactcttcttcaaggcagaaatcactgttcctcctccatcctttcctagaccacaaacccagatcacaccccactatgatcactagtctttcctaccaggccagaaggtctttgagagcaaatacacttgcttacttagttctgtcagtgccctacacaattcagatttttaatcagtgtcagttggatgagttattttccccctttgtgcctattttaacatattccctctggataaaaattctggagttgcagggcaacaaacagtagagctggccttggtccctccctggacgcactgcaattgctggtgagatggctgcctagaggcaactctgctcacagaggatcgcgggaaaaagctattcagttcaagaggtatttacctattgataaggttcctctgtgtgtcctcctcactcattaataatttcaataataatatattaacaataacagtaataattgttgttaatagtaataaaatacagcatgttccaggaactcacattcaggattatagaccggagatgcttctgtgcaaatgcatttgccatatcctgtggaggaaaataagcaaatataaggcagggtggcaggcacacacctgtgactactatcgagaggaaggtgatgtcaaaattctgggccttttttgctttcttaaatttttttcctcccaaatgaaaagtgggtgaatgaacgaaaatccactgaccatcagatgtattttacactctgcaacattccctatttttgtgagtgcaaattaattcaaataggatttcctttcctaatggcacaatcaactccactgtcttcaaagagagatgaggactgcttgaagatgagacgcttgtgtcacaaggacattgcacatggacacagagcagtgtgatggtttctaagccacatgcatcgtgccaggtagaccccactgctaaggctagaaggaactctagtgaagcactgactccaaacaaggaagggctttggtccagcaaccccctcccaccctacagcagacggctggggtctggacgctctacaacagtaagtagtctaggattccgttctaactggcttagagaacaatgagtctggtgttttgggtaattttttataacaggctcaccttttttataatatttgatccagactttgatagttatgctttatttatttagcccacccaggaaatcaagtttcctacataaatgaatcttccagggagcaaagctttaagggttctctcagaatcattattttgaccattcttatgcaaatcttttaaagacatattatatacatttatttctgaagtgactacagtgataatttaatcactgctaaggagtcggcttcatcaaaaagaacatcagtgattattctgtgttgtgacactgtgataccctgaggagctactgagatgtgaagctattttcccataaacaaaatggtcccagattacaatgcctttaatttttctgacagcttttcataattcttgtctcctccttccagtgtcgaccatcacttcttactgatgttaattaccatgacttcattttctaaactgctgccttcatttaattttatagagaatcctaaatcagtgggcctgagggagctgtcacacctctcctatggagtagtatctgtgagctctgtgtcatttttctcagagctgaaaggcccctctgtcacacttctggatttctagccatattccaaatggctaatgctgccaggaacattaaattttactttgcattctctgaatacatactggctagcagaggaggacagtggcctagaaacttctctggtaactataggaggtcgactgagattaaatcttgctgtggacaactcataaggtgggtaattgacagtggtctgcagctagaatataaaggtcttagaccaaaagcttctctgtggtgtcagggggaggcacttatcccctttcatctcctcgcaaagctgacctctctaaagctccctataatgaagaaatgagcatccaaattcccttttgtcgattgtctaaaccttttcggattcccacggtctagtaagagtccaaaaagggcacggataccttttctcttccactaaagcaagtaagaaggtgacgcatccatggtattgtctagatcaaagttacgagctgtttctgagtctggtctgccctagttgaactacagacccatgcaaaggcaagttataaaggaaggctggggccacactccctggggcaggtacccccttaatcctttctgtgactctaatctgcagtacttccctaagtgtcctgacaaaggagattcacagcacacaacctttccctgggtcttggcatgccctgaacatctagatcagaccatgagattcttgcctagctttgacttccccacctgcaagagctggggccctttccacatggcagtgctacttacagtgacaggcaggtctagaggattaaggtgcttgtcctgccggcagaaagcaaaagcacagagagaagcagacggaatgagctttcagcttacattcaaacaaggaccgggaaggcagattaacagagccaagccatccaagaaagacaaggacagacagaaccacagatgcttctggtcttccctctagaatctaccaagagctgggtacatacatgatcccacttgaatttcatcttactgagcccatgagattgtcagagaactaaaatgtcttacttttaacaccacttgggcttttctcagagaaatctagaatgttagtattggaagggctgtcagagatcatttaaactggccctttcattttacagaaagagaaactgagacccaaaaagaggttacaaacacttgtccagccagcagcagggagaatacttagtcccaggcccctcggctcttaggtcagtgtttgttccaccacccagctgattcttagtttccttatttgtgaaacagggatcttgtttttcctcagacatccttgtgaggtaaacaaggcagatgttgttgctcccatgtgacaggtgaggaaactaaggttcacagaggcagagctatctgcataatgtcacagttaatgaacaggggaaggaagatgtttagaatctccatcagagaacctttaaacctaagatttagtgtgaaatcccattcatattggactccttggactcagggtagccacagggtctcctcttccttattcttgattctgtaacccaggagttggcaaactatggccatattaggcctgttgcctgtttttgtaaataagattttattggaagacagccatacccattcatttacctactggccgaggctgcttttggctacaatggcaaggttgagtagctatcacatagaccatatggcccataaagtcaaacatatttattctctggccctttagaggaaaaagtttgaagggccctgctctcatctaagacccagctggtttcccctcataggtcttccctgggtcttccttagcaaagccaccctcctgggctccagaccagacagctaagaggaagaactcttgggaaaattgctggatttgtgctctctgcatagcaaagagtgcatggggtgagaattatctcagaagagcccagatgaaaaatgtgaaaaggcagccacagacctgtcgtttgtcctcaggagccttcagaaaaagtgcattaatcagtgcaatggcgtaggtctgaatctcctggttggagctgtgtcaatggagaaagaagagagagggagattagaagactgaacagcaagatgatgcttagaaatggtttaaaacaatcactcacagattataagcaaataatgatctggagctcagtctcaaaagcattcaaagtgggcatgctcttgacccagcaatttcactaataggaatttatcctaagacagtaatcagagagctatgcaagatttactgacaaggcgtttcattaaagtactacttaaaaaagaatggaaagtaatccaaatggtcacattagccaacatttatacatatgagaatcttaagtagttattaaaagtcatgttttagggtaaagattcttaacctgggattcagggatgagcttagagtatttgtgaaccccaggaatgatacagaaattattctatgtagtttgccaactaagtggtattttttccaaactggtgagagtatatacttgttaccagattttcaaaggtgtctaggttgcaaaaaagacttagaactacccttttagaaaaatctttgacatggagaaatgttcaaggtgtattattcagttaaaaaaaatcaaggtacacatagtatatataatgagatcccgattttgttaaaaatatgcataaaaatactgaagggacattcaatttaatgtttaacagtgggtatgtctggaggtgagataatgggcaaataattttgcgtttttctgtatttttaaagtctttgactataaacttattttattatgaacaaacaaaataactacaatcattctctggaatcttacaatcctggtacttgacatctccacctgccatgtcttgggtgcattctgtggctgtctttccagagggtctgatgggcttcctggttagtcacatggtacccagggagtctaacagagggcactaagtatccctcagcccaaaaaggaaagcatataagttctggtgacagctgtgggctgaaagtattggctcctatgaaatgccatgttcccctatcatccctagggaggcaactggggccactctgaattcagagacaaaaaaaaaaaccagagaagtagatgtgaggttacaggaaaatcagaattctctatctggagtttataatgtccctctcaccttaatcaaccttggtggctcgctgggtatgaaagctgaggctagaccaggcatggtgactcacacctgtagtcccagctactcaggaggctggggtgggaggactgcttgagcccaacagtttgagaccagcctggacaacacagcgagaccctgtctctacaaaaataaaaaaaaaaaaaaaactagccaggtgttgtggagtgtgcctgtgattccagctactcgggaggctgagatggggaggatcgcttgagcctgcagtgagttatgatcatgccactgcgctccagcttggacggcagagtgagaccctgtctcaaaaaagaaaagcaaagaaagctgaggctgaaaattccttaaaagtgacaaggagaaatcagagttgcaaagaaataattgtgctttctttttacttggattagtggggaaaaacaagttgggagcatagctgagtgaagacagggccactataaactcccaaatctgggagctatgacttcccctcgaactggtgggggattctggcaacattctgacaatgtctaaaaaacagaagtgaacaacagtcagaagagaatcaacaggagtgccaccactgttttgcaaagtccagcttccttacatggtgtaggttggttggaagtgaggtaaaaacagcggagacgggagaaacattgctccaatgggttcatttgtcatatggtctcagtatctggtaaaatgttttaggatgtgataagagtcttaacaaacaaacaaaggaaaaaagcccctgaatttactgaatacctaacccaggttggcctctatgctggacctttttaaaatctcctttgatcctcacagtgtgagaggtgaaggtgattaacctattctagagatgaagaaactgaggccagaagagactaggttacttgctgatggcagagacctagtatgcagaagagcctggatttgaactgatattccaaactcacacctgtgtgatatttcttacaaatcacccacagtgcatcgtcggttcagtgagcattcattcaacaagcactaattgagcctctacttaaatcaaaacaggggatacaacaatgattggtctctgtttcaagggggctctatgttcaaaatgggcaacagataataaaaatccagtattttatataattatcataggtacagagactactgggcccatgtgagaaagcatctaattttgcctggtaccaccctggtatgggaagactgggaaaatcttcattttaacctaaggggcagagagagttacagaggattttgggcaggagcatgacatgatcaagtctgaatgatgggagaaattctggcaggagtgtggaagaggtgatgaatgaagaagccaaccaacagcttggaatataagcaaaggagagtaggattggaagacttaaaataagaggagaaaagaggacagacaagtgaagggagggaggtgtagggttttttactcacacctggaggtgtgagatgagctgtcccacggtgatttcctcggctatcttctggtacagactctggctgttcaagaccatgctctccaggatggccagggacctctgaaggattgacacgtccaccatgggctggctcacataccctgcaatctagacccagagatggcacatcaattgagaagctcagggcccaagaaagatagaagcttagcatctgatgctagcccttgaagctctctctgcttcacatttgggcagctgttgctaggtggatagtggtatctggtttacggctaccctggccaatgtgccagggattcccttggcatggataccttaatctcagattatagtatccacttaattgtgtttcctcaaaatctaaaagcttaattctttttatcaaaataagggttccagtttgagaaagtggggtataaaaaagcagaggattttactgatactgggatctcattttatctccatgtacctcccctgacacacactccccctaaacacacttagactttgagaggtagaaaggaccttgaagccttttactctaatccttcttctcagtccccattataatatccttgacacatggtcatttcacttgtgtccagtgtcggggagtcccaatgtcctaagccaatgatagctgaagttctagggcagcagatacaatattattcattggttttagttcagtattctgaattgacactgctcctttgtgtaaaagaaaggagggtaaaaccagaagtaccctctcctacccactgaacttagtctgacaatccaaacaggctaccttgcagatttgtaaatagaaggcaaatttacaaatgaaatgcaaattttttttatatatatacaaaaagaagagagagctcaggaagtcggtcaaaagactcagggctagtactggttgactggctggctttatccccagtctcactgacaatctaattctactttgatcatatttagttctgacggtccagttccatctcagtgcaggccctgagaatataacaaaatgcaaatctttcagaagccacagaagactagagcttgaggatgaaaaatctggccccagggaatataaagctgatctcaccagaatggcgatattgcctgtatctccccttaagccttgtgaactggcagctgagggaggagagaaagacagaatgttggaggcctcacctgcttaataaaggtgattgaaaccatgtcccaggagacaatgccatggtccatgagctctaggaaggcagtcagggtgaatgccagcatctcactgtagctgagacacgtgcaacacacacacaaaatagacaaagattcagatcgggaaacacaggtgtgagggcagccacaaaaaagatgaattttaatgtgaacaccccatgggaaatcagtcgatgcaactgtaactgtaagtgcctgtgtgcacacctagccagtgtagagcagattcagcccaggtatctatcgctgcaaaaaaaaaaaaaaaaaaaaatgttgctgggtaattagatcttccttctccatatgcttcatcccagggacacagaatcacttatctatttcccaagaccaaagaagacattggacctttgtcaaactccaacacctgttgggagaacctaaggaagtgtaagtgccatgttaacctttgggccaagaggcagtagagtgcaagagatgggttcagttcctgtccaccttactaaccaagcaaattttatcttttcaaaattcaatttcttcctctgtaaaatcaagttagtctcacagcgttaacctcacagggttgtggagacgacaagatgatgatgtatgcaaagctcttattctagtgctggtagagaataaggattaaaatgttttctcttttttctcttctccttatacatttaatcctttatacatctgtacagtgctctagaattaacagatgatattcctatttacaaagcatgttcagacacattctcattaacaatacttctcacaataatactgcaaggtagctattattatcctcaggctgaagagagtgaaactaaggccagtctaaccctgtacccttgggagactgtagaactatgtcagtgctgatggcagctgaaggcttcaggacttcaatacagctggaagatccaatatgtaaaacaaatatctatgattagttactcgatttggctaacaatttcaatagttgatctatgggctgagaagatttctgactccctctttggcaggttaggctccaagcacctgtttactgactgctgctcacaaggcacagctgcccaccgcatgcatgtgaactctggggtatgatgaagatgcttgtgggtatcacaaagttctggtctcctcctccctgtgcaaaagtgtggcagggagatggtgaatgggtaggttgacacctgtggtaaacacaaaggaaggcgtgtgtgtgtgtgtgtgtgtgtgtgtatgggctgggaggtgactgaagagggaggagcaggggatgattacaaacagacacctgggagatactggaccatctgctcactaaccctcatcaaaccaaacatttccagcaattaacaggtctgtcacgacgtgactgctctcctcctgacttctctagcccctattttcactgctcacttggcacagtactgttttgtactgttatttaatttgtgagagcccaaatagactacacgatttagaatcacaatatggaattatatatcttggtatggactctagtgcttggcacactgctctgcacacaggtggtattcaataaactccttatttgactcaagggaaatgagactaggatgccctgtgggatgtagtaaatcgtcgaagtccttggaacgagaccttagtcatactcactgggacaagagcttggttccactttccacgagccttgtcagcacaatgatgccatccatgttgatgaactcagtagcgaaagtcacgtcggcagagagcttggccagctccttcatggcatccagccgggtctccatgttggatgactgggtcctctccatcagctggcgtgcagcccgggactaggaggccagggacaagatatgtgccatctgctccttggagcaggttactactctgtggatagctcacagaggcccttctgtggacatccaaacctgaggcagaactagttttttcacacagcttaggagttgctaaataaatgtttgtggaatcaatcagggagttattagtatgccaaaaccaatctgtagttatctgcatcttttctgtaccgctttggcctatggatttaaaaaattcctaccaagggaatactggaggcatctgggaggcccactaacgatggtaagtcacagagaaacagatactggtttaatagaggaaggttttctatttaagctgtcttgctgggtgcgtggctcatgcatgtaatcccaaggctttgaaaggccaaggcaggattgcttgaagccaggagttagacaccagcctggccaacagagtgacaccctgactcccaaaaaattttttaaaatgagccaggtgtggtggtgcacacctgtagtcctagctactcaggaggctgaggtgggaagactgcttgagcccaggaattcaaggttgcagtgagctaggactgcaccactgcactgcagcccgggtaacagagcaagactctctctcaaaaataaaaaagaaaataaaattggtcaggtacagtggcttacacctgtaatcccagcactttgggaggccaaggcgggcagatcacgaggtcaggagttcgagaccaacctgaccaacatgatgaaaccccgtctctactaaaaacacaaaaattagctgggcatggtggcatgcgcctgtaatcccagctactcaggaggctgaggcaggaaaattgcttgaacccaggaggtggaggctgcagtgagccaagatcatgccactgcactccagcctgggcaacagagtgagactccatctcaaaaaaaataaaataaaataaaataaaatttataaaactgttagacagcagaagaggtttctcttgaggtattaagctccctgtcagcagaagcaatcaaggagaatctggacaaccacctgtcaaagacgctgtagaagggattcttgcattgggtgaagaatttaatctgatgtcctctaaggtcccttttaatcctaaaatgtgaaaagcctggcaattttttaaaaactttctcttagaatccatatgattgttcctcaaagtgacagttctggggaaactttaagaacatcaaggagccagaaacaatttcccaattgttttttgaaaatgaaggctggtgaagacaaaacctcctcctagcacatgaacttttcctagcaggatgcctgcctccttttctgcaagctgcggctaaaatccctcctctagtattcactgggctttccttccgctgagctcattactacatagtgcctcacaatttattgtttcatcattctctgttttttgggtgttaatttaatgttctccactagaaagcaagagacttaagaacaaaaacacacctgtcttctttcctttttctcagtgttaagcaagtgactggagcccaattcctgctgccgccaaggagtcaggcctgctggccctctcccctttgcctctcctcttttactattacaaagctggcccttcaaagcacagtgctctctgcaatacagaagccctcgctatctctacagtggagaaaatgtgcgccacgggaaaaggtcatagcatagaacaatctgaagagcactggtctgcatcccacttagaaacctccaactccaaatgtcaattttcctcctgagacagcatttctgggctgctgcctcccgctccagagagatgtgcttctgggaaagtcaactacactgtgcaagaggtctgtgaaatgtgtcggcacttccataaaagtgagtaactcccagactgtcatattaaattaccagagcttaggagggaagaatgaagtccttaagatgagaagagttcaggagaagagggggaggcagaagaacatgatgggaggaatatgggcctagagtcagacagacctgggtctgagagcgggcttggctactttattagctgtgtgacaagtggcaagtaatttaacctctctaaccctcagtttccttgcctacagaatggggctatcaagagtacctatctcatgggatgtctgtaaagattagatgatttaattacacaaagtatttagcaaaatataggcattcagtaaacgctggctgatatcacttcatacctcccctcctctcagatgaaccagtctctctctgcaccaagaaaagaagtgccatcatgcccttaattttctggctgcccttctacaaatgtaaccaaaggtgcaaccatattggctgtcttcttcatgggcctagcagtcaaagtgattccctctacctgggctttgagtccttcctctcctggtccagtaaggtcctgttctattgattacctgctttcctgcaccttcaaccttcctctcttccatctgaacacattcttaagggcacataaaaaattgcaacagaaacaaccaacacgaagggtcagaaaggtggggaactgggcagatggggacaggagttgcggggagaccttttgctacatctctgtgaaaatttttgatttgtgaaacacatgaatgctttacctgcttttaaaaagcacatctttttgactccacgtccccttcgcattatcaccttctctgtgttttcttttaaaaccaagcttcttgatacagcagtagactcaaagtcctcactgttttacctttcttttacttgaccacttcagtgtggccacctggcctccccaccataacttttttgtgagtatcaccagtgtcctctaacctcccaagtcattagacagcttttctgctctcagtttactaaatctctctgcttattaaaaattgcagaccatactctcctcagtcctgacactctccctgcccaaagctcctcagtcacttcaccttcttggtgttctttctacccttctggttgcttccttagtgacctttaagggctgctcttgcacaaatcagggtcatcctccattctcccctttccttccacatctagcatatcaccatactcataaagcttacctcctagatactcttcatatccatcctttcatctccattaccacttgccttcactgggctgttaacattccttattagcctcttcaaaggttcctactaccaccaaccttcttcttaaggcccatcttccacatggtcactaaagtgatctttctaaaacttaaaatctaaacataacatatcttcctgcttaaaattcttcaatgtccccagtttccttctggacagagttgaaacctacgagtaggccatcaaggaaccttgaatatctggcttctcaatgactgctacaagcctccagccacccagcactcctgcttttcccaaacacagcatacctctgtgccttggcatatgctgatttctctgactggaatacttttccttttcttatttctctagctaattcttgctcatcctttaacatctgagctaagtgacgccttctctggcaagactttctggaaatctccaggctgagttaggtggtcccctttgtgagttcccacagctccctaagcaactttctctcaagacccttgagacaggccttctattgcatttgtttactccccactaggtggtgagaaccaagacagacttattttcctgtactatttcctgatacaaaaagactgactttcttatctccagagtacttatttctagaacagagtctggcccatggtaggtgctcatatttgtttgtgacatgaataaactcctaaggaagaaagaatacctaccggggagatagccagttgtaagattgtcccattcttaatgtcactgcgagtctgggtagtgaaaaataaacaaaaaaagtaactaagataaaatgttaaagtggtacaagcaagttgaatcaacaataatgttttgtcttttttacagtagatgtaactgaggatcttcagtcgggccctcttctcctgcttattccttggcaaagaatttctaagatcctcctctagcaccctgggcactcaggaagtaaaagccacctttttctagccactagggaagaacaagggctggtgtttcccagtctgtccggagagtgactctttacccaacacatggaagctacctggatgctgagtgaagataaatagtgccgtctccttgggtcgtttaattccaagcaaggcccatattgattttgcctctccctgtactaacctgttcggtgatgtacagctgaggaccatctgcataacggagggtataatactctgggtttggcaacgaccacctatgcaagagaaaaacagtatatcccacttggccactctcttgttcagaagctgctcataagtaattttcaaaagagttgctcaagggattgggtggcctatttggaatacagtggaaacaaagctttaggttgtcatgttgaaaaaatcatggcctcagccttttgtaaagatgagcaccacaataggaggtgtgcagaactgaggaggggtctcagatcctacctcaatagggcaatgctagactttaaggaaaaaattaagaagtataaacgtcttaggggtatggttgtcaactgtacttccttcccaagacaatgattcccaagacccccatgctgaggacctgcctaactggagatccttcccagaactcccctcaaggtgtaggagtgctctttcagtcggagctgccactgttgaaaacgaggtccatttcaacctacccatcacaaacttccttgataatggatgccaggggccgtttctgaaagagagagagagaaagccttcaacagcagcaacatcctactcatgccaaggttctgacaagaggcctgccaagcagggtcaagctggggcatgagaatgaacttctttcctaacagcttttgttgaagaggaagcctctcccaagccatggtgaccgaccttccctagggtgggccaggcccaaagcttagccttcctgttgctcgttcttactcttgatgccggtggtccccatccctcaagatgtcctctgccatgcactccccaggtgcctttccttgaaccactgcttctcacttcaggagcatacctggtcgatttcaaggagctgggcgttagcacctggccactcaatggccactttgacaatgtctgacggtggtggcatcgttcccaatgggctctaattctgcgagacaaaaacacagacacggctgcctggggagaaagaatcagaaaggtggaaaaagagtatttcttcatttttcactcttgttacatgttttgaagagtttgaagacagacactgcataaagtaacacatgaaactacctggtttgaatttttctagatcataccacaacttctgcttaggattttgtctcttgagattaaatcagcaagaagaaatgggacaaactatctatcatccatagatcagccagtagcaagatatgccaatgtggcacttcagtttaagagtcaagaagactcagtggtagaggaatgtatttactgcaaattcctgtcttgagaccttgggaggagagaagcatatgctccgagacagataagaatagacagccttttcttggttgagtggttagctggaggagccaggctacttctttctgcagtcatcctaggaagatcccagcatcagcagggcccagctacatgctctcttgcttcctccccactcatcgatgccacccctttcccctcaaaggacacaatgcaaagcctcctctgtgtgggacgacatcagaaaatggggaagataactgggacaggaaatgctattttcgtccctactgccaagggcaagggcggctgacaactcaagtggagagaggtaaggatatcctcacacaagggcccctcttataaggacaaggctttgcaagtacctctgaccccctcccccacttctctccaaaataaaggaaaataaatcatcctgagcaagtctggaagatgggcccatgtgactggtatcctaggcaactctgatagcttactggtattccaagcagtaactaaagcattctctctccaaggtctgacgaagggaagtcacttggctgatggattatttcaatgtatatttacactccttgcctacaagttcaggagaggcccctctcttaatgaaaaagacctttctgcatcctccaggtttagccattcacccacaattcatgcctcgctaatggggaccacctgcctctcctggcgtacaaagcatagctgtcgcgaggctattatgcatgtatgctatcaatttttcagcccaaacacagatgtcagttctcacagcctggtaagtataaacctcttagatgaaaaggagtaaaagtcctgtcccccacaagcccatcggcctcagaaagagggatgctttcatgaccatttcctagtcagaatgggatgcttcagaagtctactgtcataaaaagccagcatttccagaacatgacaatgtaaaggaactagttttccaagtgctttcacttattttattgtgtcctcccagcagccccacgaattaggcagaacaggattatcacctccatttgaagatggcacaactaaagctcagtgttttgttaagtgcccaaggtcacccagctagtaagtcataacggttgacagaacttggactggcttcggccaatgctttccccttttcctttgagccagcctcaacttctgtccactgcaattaaacgcagcctaaagggattgaagtgggttggccttatggcccccaaggcttccataacttctgcagctcatggcagaatttttcacatgtaatttttatgtgcctagacacacgacaaacctcagaaaagaaactggccctatctgcataatttctggggaaaatgctctgctccagttacagcaagacagggagttcttgttctaggggtggcgccatcaatctctggatgcttagagatgcatccttatccttatcggcaaagctgctgcaattagtagacaggactgcacggttgtgaggtcaattttaaaaactgagatataatttacatacaataaaatgcagagggcttaagggtacatatgtttgtatatataaatatacatcatataaatatacacatgcatctccctgtaaccagcactcaaaacgagacactgaacattttcatcaccctagaaaattacttcatacttcctcttcccgtcaatccttccagtcctttaaaggggaatttctgacttatcatcatccatgagttttgcctggttttgtacttcatataaatggaactatacgatatgactttttagatcatttgtttagtttggcttcttcttatttttaaaataagcaggcacagaaggtacaacagaaagaacactgggctgggataattgtccctgctgaaacaagtgactggatttagaaccaaaggcctcaggacccaatcctaggtctttcacaatgtatacatggccctttaaccaaatctcagttttcttctattgaaagatgtgagtgtagaactaaagcatgtctcaggtgccttctaagtctaaaagtccatgattcttaagtggaatttaaaaaatccaagtgaggatgcccattttaaagtccttaccaaatgaagttacacccttccttaatttcgatggtgctgctaagaaacaaaccccatgatttttaactcctttctgaacgccgtctttggagattaagctaaagctcattaggttatagctattattttctcttgaccccatatgacatatcctagattgactctctctttattaaagttagccctgaatgattctcggctgttcaaaaattcgtatacattttaaagcatggagatttgcaaccaccaaactatttgaaagatattaataagcccccattctcagtgactctgtccttcccacaaagcccaggcagcctctctgaactgaatgacactctccacaaccctgccatagctgatgggactaaagtgaatacccaactttagctgaactattccagttctttctcttgaatttaaaagacagagactggctgggcgtggtggctcatgtctataatcgcagcactttgggaggccaaggtgggtggatcgcctgaggtcaggagtttgagaccaccctggccaacatggcaaaaccccgtctctagtaaaaatacaaaaagtagccaggcatgatggtgggcgcctgtaatcccaactactcgggagactgaggcagggaggacagcttgaacccaggaggcggaggtttcagtgagcacagattgcaccattacgctccagcctgggcgacggaatgagactccatcataaataaatacacacatacatacatacaaacaaataaaagacacagactaagggaactgggtgataatgaccctggagaagtaagatcatagtaagcttcagagcgaataccatggcaagccaaagatccgtacgagccaaagatatggagaataaaaaaccaagagcctttcagaggaagtgattctgcaggaggaatccataaatatctaaatgaactgaggccagaaatcagaaagagatggaaaagccattacctgctaactttccagattatgtggctattacttcctatgctcggggtacctgaaagtccactgtatcctgccaataaaactcctataaattaagctagtctatgtttctactcattgcaactaatacgcctaagaccacagctgcccccaagctctgcaggaactctaaaacggaggtctgagcagacagcagcatcactagcatatgatgatggtactgggtaagcacttaattaacaatggctgaattaatgagagcaaaacccatgggtttgctcttacccactagataagtctgatttgtttgaaacagatcggttatatggtaacttcatagtaatcatatatctagtagtaacgtacaggtagcctctttatttttatttttttaaattttttttaaaagatggagtcttgctcttgtcgcctaggctgaagtgcaatggcatgatttcagctcacttcaacctctgtctcctgggttcaagcgattctcctgcctcagcttcctgagtagctggaattacagatactcaccaccacgcccagctaatttttgtatttttagtagagacggggtttcaccatgttggccaggctggtcttgaactcctgacctcaggtgatccatctgcctcggcctctcaaagtgctgggattacaggcgtgagccactgtgcccagcccaggtagcctctttatagttgattgctcacttctatatcattattatagttgatgctcataagaactctgaaaaacattcctaccttacaggtaaggcaactgaagttcagacggattgacaaacttgttctccatgtacctctttctacacctccctcctaaaagaaggaaggaaagaaaaaaaatgaagggagggaaaagaaataaaactaaatcaacccaacacatcagaactgggtctcaagcctaggtcttaggactccaaagcgagttctcatcgctctatataatacttccttagatgatgacattagctagcaattacataatgctaaggcactattttaagggctttacatatattaattcatttaatccacacagcaatgctgtgtggtatgttattatccccaccttagagataagaaaatggaggcacagaggagttaagtagaaggctcagtgtcacatagctagcaagtggcacagccagaatttgataccaggttgtctggtgttgctggaaagccatgagaaagcaggtggctctgcacctgacccgcagcaggtgctttgtggagatttctggtttgtgtatctgaaaccaaagcacactgaggctaagaaaccttcacagcaagaactcaccattgtaacagaagacagctctccactgtctacaggtgggccacactccctcgtgtgctatttggtcctttacaatctagccatcctggactacgggctatttctataaggcaggccatgttctttcaattcttctgtacctttgcacattctcttcctcctactgactgtcagaagagctcctattcaagcatcagagcctagttcggatgttacctcctccttgtactagtcttagctttctctactttccctggcaaaagtaaataggacaggggcctctgtgttctcacagcatcctgttcatacttccgttaatgagtacgattttgtcatactctattacagttacatatttacacatctccactagctcctcctccagaacaggtataactctgcagtctcataacctagcacagcacttggtgtccagtgaaggctcagtaagcacctgtgtctgcttaaacccaatggctctgatttcttccactcctgtgaaccaggctggctccaaacagacagggacaggcatgaactgtgcaggctgtctggtgttccctctgcgtcccaataccctctaactacacagtatttccattgtttaacagtttgttttggctgggcgcagtggctcacacctgtaatcccaatgctttgggaggtcaaggcaggaggatcacttcaggccaggagttcgagacatttctctacaaaaaataaaaattagctgggcatggtggcgtgtgcctgtagtccctagctactcaggaggctgaggcaggagagttgcttgagcccaggagttcgaggctgcagtgaactatgatcatgtcactgaactctagcctgggtgacaaagtgagatcctgtctctattaaaaaataaaaataaaataaaaaactgttgttttcatatcaaacattagaataagtcttactgaaaaatcagggttagcacccctaactctagttgaaagaaagaggaaaacctccctctgcttttctccctatcgaaaagaaacatcaggagataggagactagaaataattctgttctccagataatattcccaggataaaggatctccttatagggaacccttccagcacgtgtttgcttactcccttcattttcattctagaaaggaagtagaaattaggtcaaaggaattcagtaacattgcaaaattctcagggttataaatagcctcttgctccgccactcagcagtactgtagctcaattgcaaaccaccagcataagggagctgtagttccatatccaggcccagagggccccttccggattaaacaactccccacccttctaccttccactcctctttaagcattacagatataaggatgatttggaaaactcaaaatgctacaaaacaggagacaggcacacactgacctgatgacaattttactataagtcataagaatgaaaggccagtttttcaaacacagagctgggaaaagtagagaaaaataggaacattagtgtctccaatggagcagtctctaagtggcttctagaaggtgtgcttataaaatcagcactgttacagaagccccatggagctttatcaatcacccatgcagtgactgctgcttcacggagctggattctgagagcaggattggaaaccgaatcttaaggaatgaagtgaaagatgatctcctcctattagtaaggaatttgggatgaagaatgccaggtttccagctcccctccttccccctattcctttcaggataagaacggatgtgtactttttgttcagttatttggcttttgatttggtgaaggaggcatgggtaagtttggtttatgtttcctgcaacagaatgcaacctcatcaagaaggcaagttggagtcacgccctttctaatcgagaacacaatctctataaaggcttccccctctgaaatcttctcatctgagaagtgattcaacttcccttagttcagtccactgaatgacgatcagactctgaggtacagaaaagggaggatttgactggcagagattaaggttcttatgtttactgctggaagccctgggaaggaccaccataccaacagcagctgaggtttcccctttttgttgaagtatgttagacacaggactcattcacacatggtaaaaagccacaaacttacatagaggcaaaggtgtggtgagaaggggtgtgggggcaggggaactatttgggtttcttcatcttgattcctgctgtaagaatggcctgggtcttctcttatcctgcacagacaccttctgtagtgttcctatacttaaagaatagtgcttaagtaagctccttagcagagcattcaacttactccagttccaccgtggctctgtggtggaactggctttcagattcgcttttgcagatgccatgttctcaccagaccacctgttccctgaaaaaccatgctcttctgagtctgtatgtttgcttgtgctattatttcctcttccttgtccagctggcaaacttcaactcaaccttcaaggcccagctaagataatcactcttctatgtggctttcctaatcctctcacctcagggaaaattaattgcagcctcatctgtgatcccagtcttctgtacataccttcctgatcctactgatttataattctctatgtgcagtctcttccctggctacgataggtgtgatgtgcataccagcagcggcagtatccctgggagcccagacccacccaatcagaatctgccttcaaacaagatcctgaggtggttcaagtgcatgttcaagtctgggacataggctctagatcagataaggtccgagaaacagtggttctcaactctggttgtgcaccatcaacacacaccccaggtcatttataaactctcagatgctcagggttgacccacagctccaggagagttgacaacctgagggcaaggactcatgaagcctaagtctattcccccatctactcttcccccagtttgcagcacactgcctgccacatagctgtgtccacagaattccacaggaaaattccctccagggtgcctccagacctaaatgccttcagaagagagtgaaaacactactgactgaggattattaattgcctagaactttccaaatccctaaccacaatgactgaagagatgaatttacaaaaagtcagtgtttacaaaccacttacctcagtttttggaaatgagaggaaacagaaactgagatggaaaatacagatgaacttcagaattaaactttagaaaaccgtgattgcacaaggagatggagcttgggtagggagggagtgtggtgtgctgggaagagtcctgggttacaactaaaatctcgggctgtgaactccttcaatactgaccataacagcacagcattgttctcagtgtaaaatcaggccaagccctttcattacataaataagggaactgaagtccagagaagctggcaaggccatgccaccagttagggacaaaagaaggcctaggcccccacttctggtttagtcctcctcctgcagcacagctttgccacaaacacaagcctttctggacctcaggtcctgatctacatcgggggctggactagatgtttttgagctttcttccaactttggccttctagtgaggaagtgtagcttaacaagttaggagctgtgttctggagtgggaaaggcctgaacttggatcttagcactaacgattttcttacctgtaaaatggggattagcatcaactctaccccgtaaagctgttgtgagcatcaagtgggataataaagcactaagcataatagcagaattctaaccgtgtgaacctgaagaaactgcaaaagctctgaaaccacgtttccccaacacagtaagccctacctgctaggcaggtatgttgtgtattgttgacaaaataagagagcatatgtgaaggcagtccgggaggaaagtcaatacaaaaggcaaagcatttgttggtgttccactattattattactatttcccagtggaagaactttggaaaatgttatgatcagttccaaagcagcagctaatacaatgcctggcaaataagaagtgctcaacaaatattttctagtgactcacatgaaaccagcatagcatgcctaatagggttataaattcaaatgtcttgggcagccaagcaggtaagtaaataaaacaagcagcctccatgtagggtctgtaacactgcaaagtaccaccttgcctagaggagtttaaatccaacatttttaaaaacacatcatgcagcttggccaagacagccactttgcagcctccagcccatactgattctggctcttcattacacctcatgatgccttgcataccatctagtcattttatgtgatccagtcttgtctttccaagtatacctgaagcatcctgaagatgaaggctatgacatacaccgcccaatcaccaaaaatggcttacaacagtgctggtcacgtggtagatactcagtgagcaattgctgaactggggctgtaggccgggcgccgtggctcacgcctgtaatctcagaactttgggaggctgaggtgggcgggtcacttgagatcaggagttcaataccagcctggccaacatggtgaaaccccgtctctactaaaaatacaaaaatcagccgggcacggtggcaggcacctgtaatcccagccactcaggaggctgaggcacaagaatcgcttgaacgtgggaggtggaggttgcagttagccgagatggcaccattgcactccagcctgggcgacaagagtaaaactccatctcaaaaaaaaaatagaaaagccaggctataaactcaagcctagtattctcagcacctctgagatgctgcatggtatgtgtttttttctatccaggtcctgggaccagacttagtccaggctgggccgaggtatggtgaccaggtcaaaggacttgccttgcagggttttcttcaactgcatcaaatatgcttcttgctgagccaccttggcaggtggtactgctacatctggacacattatctgagcacagaacaagctagaatatgctgtacactgaagtttttaaagaagtttggtcctgacttcctgtaccctcaaacttcctttgcacctcctagagtccacatcagatatatagaaagaccagactgaagatgaacagatagaggtcctaatctcacctcctccacttacaaactctagaattatccccggcaggcaacctcttttagaagcttcactatcgatatcagtaaagtgcagataacaacagttatctcaaaagactctagagggtatacaaagtgtgtgacactgtacagcccaataccacaatccctggccataggtggttactaagcacttgaaaagtggcacaggctgccctctgtgtaaaatacaaaccaggtttcaaaaacttagtacaaaaaacaagaacgtaaaatatcccattaataatgttttaatattgattatgttataataatataattttggaatatattgtgttaaatatattactaaaataatttcagctgttccattttttaatgtggctactagaaaatttaaaattatatctatggctcacattacatttctattagacagcagcatcactctagcatagagcctggcacacaaaaagcattccaaatgtcagtttcattcccctgcaggtaggacatcagtgaccacgattcacatccccttcctcttgccaaattcaaaccctgcatctatttatttggtaaatatttatattgcctggccctgtgtgagatgctagagatactacatgaagcaaaaccgacactatcttcttcgtggaccttacaatctggtgggatggacagagaaatatcaatacttttgtaaataaatgtaaaattgcagttgtgcaagtgttgttaaggacaagtacccagggtgataaacgtggggtactggtcgaaaagtcagggacagggatgcctcccctgcagaagtgatgcttaagcggagatctgaaggatgaagaagagtttacaagactaagccaggggaggaagagcagaccagggaggaggaatactaaataaaaggccccaaggaaggcaggagcttgggatgtagaaggaacagaaagaggccagtgtgtggagagcactgagcaagcggacggacgagtagacagacttgggagaggtcagcgggaccggatctccagggcctgggtgaggttctggatctgaccctacaaaggggtgggacgccgggccagtttcatgccctaagcatccagatctgctctgcatttctcggctgggcgcggtggctcacgcctgtaatcccagcactctgggaggccgagacgggcggatcacttgaggtcaggagttcgagaccagcctaacacggtgaaacc[137 bp omitted]cactccagcctgggcggcagagcgagactccgtctcggaaaggtttcaaaaaaaaaggaaaggtttctctgggcacggtgcaaggccgacaggagaagggcccctgtgcctgcgcagggcagaccagttaacacactgcaactgcccaggcaggaagcgagaggggcctgaactcaagggtgagcgcaggaggtggaaagtacatgcaccggggtgctactgagccagcaggatccacggggcggactggtggacgcgggcagccgggtccaggttgagcatgaccccgggctttcaactcgtgcgggcccgccccgagcgctctccggcttcttcccagccctctccttgccgcccctccccgatcttcccacccaacgcctccctccttctccctccgaccgctgcccagcccagcccccgtgcctgactgcctggcccgccctcttccgccacgcgacgccccttctgggtccaggacccggtctctcctcccttcctaaggccccggcagggccgccacccctcgggggcctgacgagccggcgcggtccagcccaggcccgccctctcagcccctcagcctccggagcagacgctagccgcaacgctcggcccggcctctcttccctgcgtctttcgggccgggcccctctccaccgcctgccgcgccccgacccccagggcgcccctcactcaccagggcgcagacctaggcccagctcctgctcccgggtctccgctcggcggctcctccagcctccgcccgccccgccttcttgggaccccgccccgcacaggccgggcccggcttctattgctccgactcgccgtcacgctgaagtctctttcttcaattaggttgcttgtctgtcactcaagaaggggcgggcacagctgccggtagaggggaaaaacgccggccgtccccgcccccctagtggaggcctcttaaagaaacaggacgccattcccctgcgggctacagggtctgaaggaaggtaatttcccagctaacccaagaggcagctttctttttcccccaaacttttttttctttttggtatgcagtcctagagtgaaggaaaaggcttttgctcgctgtgtcaaatcataggttgtgagctctaagcgggcctctggtggcactccgccctgtgcccagcgggcacttaccgcacactcaacagtggggatagctgtggtttggggaactgagtgggaggtgacagtcgtgtcagaggctgtgagcagccgcgctgctcaccaccgagttggagctaattataccggcacccagggctgaccgtgggcgctgagcagaggcagaagggtacaactcagctgtgctgttggaagggatccgtgggaggtggcattcgtcactgcacctgcggatcggaacaaggccgggcaccgcgccaaggactcactcctgctgtctctcttcatgctcacagcagccgtgtgatggagggagcaccgtgatcccttcgctgcagatgaggaaactgaggctcagagagggtccgagatcttacagctggtgaggggcagagcaagatgccaacctatgcctgttggattccaaagtttatactttaatcgtttgtctagcagattcttacaacaatcctgggaggtgtgtattcagctgtccctttgcagataaagaaactgatactcagcaaagagacgatgtagtgactaccacttgtaggccactgcgcagtctgcaaagcagttttacatacgttgtttcatttgatcctcgaaacatcttggaattaaagatgatttttgttagtcctattttacaggtgaataaagtgaggcttggggaggttgaggcttagccatagctaacattgctaaaactctggcaggagttactctttctccttctcactggctggacccagccttgaccttgtgatgatgatgacgacgtgctagggaacagagctacagcacaggaggtgccaaatgctacctgcctacttgggacactcacttcatactcttatgtgaaagcgaaatgatcttctccgttccttttattattaactttgatagcagggagggctgtttgagccaaccctgcactcacacaacactgaggaagaaaggcttaaattttgtaccctgggtgcctcagtttgcttcatcctagtcctggctctgcttaataacacatttatccaaggaatgaatcactcacttgagagctttacaagactgtgtcatttttttttcctgatattgccagtgcaggttctttgattgccagtcttaggaatcaattctggctaactttacccaaaaaagattttattggcaggctagtgtttaactcacagaggtaacaggaagctggagaatcaggcttagaaaaggacagaaagtggagatgctttgagagtttaggcaggcaagtgaatcaattccatgtttttcttccctttcttgaccagagttttctttgatgagtcaaagtccctggagcaagggttcgattggcggagctcaggtaacatgtccacactttagctaaggagggcgggcaacttgatggacagctccaccaagactgcacagaagtgcagagttccagatccctcttcctccacctcagctgctcccagtgggcaactaggttcaggtgccgtgttttcaggctggaatcaaataggaggagtacctgcagctgaatgtcatgattacacaaatgcaattgtgtctggcacgtgggagaggatagtagagattctgagctttgtaaccttgcagacctttgtgctatttaccagctgtttgtccctgggtaagttactagatctctctgagcctgtctcctcatgtgtacaatggggagaataacagtaccagccttaatggattgttgtgagaaatgagatcactgtaaatatacaacagttagcaaaatgtctgcatttaagtgctcaataaattgtaaattataaaattttaaaattatagtaggccttccataagtacttattgtgtgagtgaattatctacccctctcagttctctaatccatttgacttttgttttttgtttttgagacagagtctccctctgtcactcgggctggagcac[132 bp omitted]acggggtttcaccatgttggccaggctggtcttgaactcctgacttcaagtgatctgcctgcctcagcctcccaaagtgctgggatcacaggtatcagccaccacactgggcaaatatggcccatctttagagtggtgggaagcttagagacaaaatctttaccacggtctacaagaccctagatgatctggcactttacttctcagacttaatctattcctactctcgccctaacttactgtttgagtcttacatactaatttcccattctgtgaacacacagtttcttctcatctctgtgcctttgcacttgctgttccctctcctggaatgctcttcccccagctcatcacatggcttccatcttcactttattcaggccatgctctgttatctcctcttccaagtcttccctgacagcactgtctcctatcatccagccgctccacccttctcttcccttaacttgctctagtcttctccctagcactgcatgtcatattactttgttttgttttctgacttccccattagttgtaagctccatgatggcagagatcttgactgtcttgatcatagctgtatctctgctacctagaacatatctatta[450 bp omitted]gtgatctgcccaccttggcctcccaaagtgctgggattacaggcgtaagccactgtgcccgtcccaaaaggatttttacatggtagctcataaatgtcaaaaccttcatttatctgctaaaggaaatagaactagcatttatcatgggtttactatgtgccaagagttataccggaggctgttatacacattaccacacttaaaactgtcaactttctatggcagattagtgtgcccattttgcagatgagaaagattgaagattagagatgtgaaaagcttgctaaggcacctcagcctggctggtactcagtcagtccgactttctgtttacaccactcagtggaaacagcattccactgcgtatttaattcttcatttttttcacacttattaatcctggatatagatgagactatgtattaaggtctttacatgatttatctcatttgatcctcatgtttctacgaagcacatactgctatcacctttattttacaaacgaggaaactgaggcacagagactttagacatttgcccacggttacctggttgagtggtgaagccagtatttaaacccggctctatttaatttcaaggcctctgtcttttctgcaatagcgcgctgtctccattaagaccactctctgcctcagatagaaagagaagaaaaatggctaaaacaggcgaataaagtatcattaagaaaattcatggtgacttggttcttgaaacgggaagcaaaagggcaggaggcagacagccagtctagcaccagcgcttgcaggctaggggttcacataactcacaataacttaattttcgaagatcgttcttccaggaactggggggtgagggacgtggttatgatgtatttgtgtgagtggagcccaggaaggggccggactcttggtgagcagtggctgtcagcccctggaaggcgtgctcaagccgcctgcgggagaccagcgccctctgctggcatcggaagccaccttccaacatcaagcaagccgggggggggggggggcgtgtgtgtgtgtgtgtgtgtgtgtgtgtgtgtgtgtgtgtgtgtaattggggaagcaatgagatttgaaaatttgtgtgtgtgtgtgtgggggggggcattggggaaacaatgagatttgaaaattttcatttctttttttttgagacagcgtctcactctgtcgcccaggctggagtgcagcggcgcagtcatggctcactgtagcctcaacctcctgggctcaagcgatcctcctgcctcagcctcccgagtagctgtgactacaggtgcgcgccaccatgccccggtaattttaaagttttttgtagagatgggggcctcactatgttgcccaggctggtctcgaactcctgggctcaagtgatcctcctgccttagcctcccaaagttttgggattacaggcatgagccactgcagctggctgagatttgcaaaatttctaatgcacacagtaaatacaaataatagctgccacttagcaatataacattggggtggggatcaggggctgtttaaggattttacattaatttatttactcctaaggactttacatactgcatctaacttaacctttaccctgaccccctgaattaggaattattgttaggacttcgatttttcacacgaggaagctgacagagagattaggtcatttgctgtaccgctattaagtggcagatcagaggcttgaacaagtggactctgaccttccaggtctgtgccctggaaatgaccatgttgcccttctttgggtctggagtgccccctggcaagtctccttgtacagaacctcactcagagcagacacacagcaagggctcagtgcttctgaaaatggtaaccaggctgggacttggtggtgagtttgctgctttttgtattcaagctcagggaggctgtagactcgctgggtggctggccttagaatcccctgcatctgtctgaaccagagacaagcccccagccagtgctcaggttggcccctgggatctgcttgtccaatagtaacaacattacaatagtacaacattttgtttggctacaacaaagcagacagtcctaatgaacaatgcaaaacattcagcacccagggaggcaccagtactgacagatcagaacagacagcaccccctcccaccccccagggtcccaggagacagtccctctgcctcccccacagtatatccaaggctttaacccttttacttactggaatgtggggcattggaggtggaagatgaggtcagcgttgctggggaagagtggtttgaggcagctactatttaccaatgaatatggaagaatttcaatattttaacagttggtgtggctatgctggctgaatactgccatccttactgtgggtcctggggtaatagtaggaactaactcatgggtctggtgcaggggttacacaaagaaaagcaagtaaagttcctgcttctacttcagagaggtattcagtcaatgagagttggtcttaatggcctgaacagatgtgtgtgtgtgtgtgtggggggggggttgttggggtggggagaatgagctagtcttgctgactcccgaccctgtctcaccatccattgtgttcatcctcttcaattgtagctgagtcctggaacccagagcctggggcgggtttgggggttccttaaccggtgtatggtcactttgcttcactagacacctccctgagtgtctacactcagttctacagaactggctcagtttgtccagagcagctgcccatttgttgaaaagttgaggcagccatgatagaggaagtgaaggcctggctgtggagggctggctgcgggaagtgaccatgagatgaggctctggtttatctaggaagacctctacatatgatcgtctatctattctttccacaaacatctgttgagtgctctgtgtctgctagctagtggctgtatgttagtgatcaaaacaaacatggtccctgtcctcctggcattcacagtgatacaggggagacagacagcatataaagaagcaaacaaacatatcagtgtgactataaactgtgataaatgtaataggaaaatggttaggctcacctccctacattccaacaatcaaagcaggaggagagcgtagtcatggaggtcctccctgtggaggtgatgattctattgagacctggtagatgaataggagttttccaggtaagaagtgaaaggtggggtgttccaggtagaaggaacagaaaaaaaaaatcatgacttcaactgggtggttggattacaaaagcagagagaagagaagaagagaagagaagagaagagaagagaagagaagagaagagaagagaagagaagagaagggttaaggagaaggcaggcagctactactaagggccttgttggccctgctgtggagagggttagttttattctgtgtataataggaatccattggaagcttgcaaacaggggaatgacaaaatctgatttaagttttgaaaaatatctagttggttgctgtgaccagattgtgttgagactagcttgtagaatacgaagatggaagcaaggagtccgagtgggatgtgaatattaaaaagcccccaccctcataggaaaagactgattgttctatggccttagtaatgagtaaccaccagaactggtcttaagcctaataggttaatggcaactcatctcactgaatctgcatctgaaaccaaccaatcagtgatagtctgtgctttgagaatcagccaagctgccccagattcactgcagtgagtatgtttctcaggctggtgtcacccctctctctgcttggaaaccaaactcatccccaaacaaattattccccaaacctatataagattaacagtttgttttgctcatccagactatacctgaccattgaagggctcctgtgcttaaagaagcaagaaatgcagctggttgcagacactaaggggtggttttatcctccagtagaggttgccttaggctgatcaggctgctacaacaaaataccgcaggctgggtggcttataaacaacaaatatttatttcttacagttctaggggctgggaagtccaagatcaaagtgtcatcagatttgatgtctaatgagggctgccttattagttcacagatggccatcttctcactgtgtcttcacgtggcagaaggggaaaggagctctctgaagtctctttttttaagggcaccaatcccattcatgaaggttccacactcatgacctaatcacatcctaaaagccccactctaaatacaatcacattggggattagttttcaacatatgaatgggcagtggggtggagggtagggggcacatgaagcagttatccagtctatagcaggagtctttacagtcatccaggctatggatggtggtggtctgttctcttgtcactgctgaggatgtcatcctggggtttattctctgaccctccctgggccaggcgcctatggctgacaaacccttttctgaaggacattatctttctttgaagattttatgtctttatttaggtgtaccgttgcatcttgtctcgggatgttctgccccttcaagggaatgtgtcattcggggttgagtcaggagagagaaaccacaccagttatttgaacagacataagtcaatataaagaattgttaaccaggtataaagttgttaagtaggtctctggaaaggatcaaaagaactctaaggtctcatgggggtagcgactgcagaaagcatctaccacctctagggctgaaagaaacaaagaaaagacattgaaattattaagacttagaatctggtctgcaagttttgaagaaacttgcaaactggactcagctggtgttataagaagacactgcaccgctgttgccaaggtgaataagtgatgctcaaaacaattccacaaaaagcaaacaggaaagagcaaagccttttcctcttctagacttgtagctcccttgagcactcccattagcagagactaagagagctgctggtgaagcagaagtgcagtttttcagaattccagctccagcaccacagaccagggtatggaaaggtaggtttggagctgagagccagcagcttaataacgggaacaggggacattatatttctctgtttctatcccgtttttacaaagtgtttaattatcagacgtcagcctcatttctaaaatttgggggactcatctcattgtcacctcaagtgcttctcttaagttgctttccgtttggttgtgggagcagacgcatgtacaatcagctgattcttagcaacatgtgatgcttttggtgaatgaagggccggaggaagtggcggaatgtggggacatgtggggacagttcagcctgaatggttctaatccttagaagtggcacaaggcatttgtactaggcattgaagcatgagtgatgagtagaattccaactgagttgacaaaagagtcactgtaaggtccattttacagaagaagaaactgaggcccagagagttcgtttctggagtcacaaagaaccacgtccgtccatccaactgcttagcctggagtcctaaaccattgccctgtgaccatagcttgcaatttcttcaggtttatcatcctataaaactggaataatgatatttgccttttggggtagtggtgagggttaactggtgtcatatattaaaaacataaacccattttggaagacagatgctgggcacatttccacgcccactcaccagccttgctacttgtagttcaaattcgtgcctcagcaaagttataaatcagtccatgtcatagatctgaaggtgggaggggtggtggcgttcttacatagttgaaaccaagaacataaaatccttgaatgtcattatctcagtgaatgctaataataaggataatgataataatggtaatatgcttccacttaatgaatacctactatgtatgtgccaggtattttacatatattatatcacttttgtctattcggcaaataggtatttagtgtgcaacacatgcctggcattatgttaacgctaactgccataatgaaactgagtgtaggtcttatcattcctgtttaacagatgatgaggttgagactcacccctctggcctcttttctcacttgtacaacagggacaataataatcctacctgcaggatgcatcagggaatacagttcatatagcatattgcctgggacatagcagatactcaatgtatgcttgttacttaatagattagcactactatttctgctagtgcaaccactgctcagggtcacagagctagcaaatggcctatctgactccacagcctctgctctgtcccctctgtcatgctctttatgctacgtcagtctttctactatggctgccttcccacaaaggcaggcctggctttactgtaaattctgttggaagaaaaggaggagcagccagagggcaccaagtcacagcagaaacagctgttttgaaacagaggcaggtcccaggagtagctattatcatttttttctcataaaagtgatctacggatgattgggtcaagatggcagatgggacacttaatggcagcctcgccccacccctaaatatctagaaataacagaaatgtgtgtgtgtgtgtgtgtgtgtgtgtgtatgtgtgttccaaaaccatatggaaaatcaggaaggcatatgtctccagtggtttagaaactacaaaagatgagattaaagagaagtgaaaaaagcctcaaacacaccaaggcagtaactaatgggtgtcatttcaagggtggtacatacctagagcaaagaggttggggacataggggattgatttggagcagtgcaatagaagccgtcaggcatggtgaccagctccctcccatccaccctgctttggctaaatagtaagttacataagtgtctccccgcagatggcagcagtaagtctgaatgcaaaactgtgtcctgggtgagcaggttgagaaacagaggtctccaagtccagaaaacaaatttatattctatccctggagttagactgtggtgaacagataaagcactttcagataggctgacaagaaattttaaacttcaaaataaaaacatagccaagagtcaccagatatttggaaaacccaacacatgaaacagtaacatcaaaaacaacaaaccaaagaacttacacctgaggaaacagagagcaaatagaaccagactatggaataagtatcattatataccttggacaaatggcagagcctactgtattcatattttaaaaaaataaaaaatgcatcgaggttttagaaattaaaaaaattattcttgaaataaaaatctcaatagatgggttgaatagcaaaatggattgaagagtatatcagtgaatcagaatatcatgctaagtaattctcccggaatgcagtgcaaaacaataaatagatgggtagaatgaacaaaatgttatgagacatgaatgacagatgtaaaagttccactatctgcttaatgtgaattagaggagagaagaaaattaaggaaggagagtgcctaaaacaaggcaaaaatttaagacaatttcttagaaattggaaatactcacattgagaggaaccagtgaatatttacaggaagaatgtaaaaacactgaaatgtaagtaaatcatgatgaaatttcaggacattaaggataaggaggaaactctgaatgttttcagagtgaaaaaaaattaggcaggatggaataagaagattgataccagactttacatttgcaacatagtaagtgagaaaacagaataacatgtttaaagttttctggtgaaaatacttgtgaacttatgattcttgttaaagtgaactaaatatggcctgagaaggactccatacttgtggactaaccataacctaacttaatagacaagattgaaaacctagcttaggagtatgcatctgtaacagtagctgagtcgtggccaatcccagcagccatactccaatcactcatacgctgctccgtgttccaactgtgttcagataagtcaaagccaacctgtaaccaatctagctgtttctttttctttctttttttttgagacggagtctcgctctgtcccccaggctggagtgccacggcgcgatctcggcttactgcaagctccgcctcccgggttcacgccattctcctgcctcaggctcccaggtagctgggactacaggcgcccaccaccacgcccagctaattttttctattttttagtagagacggggtttcaccgtgttagccaggatggtctcgatctcctgacctcgtgatccgcccgcctcggcctcccaaagtgctgggattacaggcgtgagccaccgcgcccggcctgtttctttacttcacttccaatttctgtgtgtcactttcctttttttgtctataaatttgttctgatcatgaggcatccctgaagtctctctgaatctactgcagttctggaggctccccgacttgtgaattgttttttcttcttgctcaattaaactccattaagtttaatttgaagtgttcttttaacattctttaaccagccaaactgcaagtgaatgtgaggacatcataaagacattttaagacacacaaacagattcaaaaagtttataattcactgtccacatagagtaacctttctcaacagggtaccactggcatttggggtggaacaattctttattgtgtaagactgatccacacattgcaggttacttagtgtccttgaccatcatccattaaatgccagtagcatttctcctccccgtgacaatacacagcagccccacatttggagggggtgctgtatcacctctggttgagaaaccatggtgtagaaaatatattcaaagagaaaataaatctaggaaaaaaaaagggatataagaagcacaggtgagcaagaaaatcagtaaagtttacttttaagtctaaataaattataacaataaacctataataataaactaaaatctgagataactcaggatggagagttatgaagtctggaaaggaggtaagagagagaagtaaaagcatgctaggagcttcattttatttatacaattagctctggatgtcaattaataatatgtgcaactatgtatacaaaaatacaaagatacagaaactaaacatatacttttcaagtcattagaagaaaagttagttgggaacaagtaaaatgctagcagctaaccaaagatcagggatgaaaaagaaacacaaaaacagcatataaaatagaaagcacaaggtaaattggtagaaaatgtgcaaatatatcagtaaccataagaaatatgactatatcaaattcgctgctaaaagacagtgactttcgaattgggtttaaaaagagtcaaaccgtgtgtttttgtataagagacagtaaaacacagtaatatagaaaggttgaaaataaagagttggaaaaggtaactgggaaaatgccaggaaaaggaaagcaagtggtacaagcaatcttatcatttgacagaacggattttaagaaaaaataatcattgttactcaaaaagacaaaaaataatatttcatagtgataaaatactcaatctactaatcagtttagccttatgcttgtgtgtgcctagtaacataggattgaaatttgtaatacaaaaacagaattataaggagaaaacaaatccatgacttcgtgggaaacattacctttagaaatctatagaacaagtagtcaaaaatcaagtaagaaacaaagatctagtaccatgatccacaaggttttattattaatattattactatttatttatttattactattttatttactattttatttatttactatttattttatttatttatttattatttattttatttatttatttactatttatttattactattgttctatcacccaagctggagtgcagtggtgccatctcagctcactgcagcctcaacttcccaggctccagcagtcctctcatctcagcctcccaagtagctgggaccacaagtgcacaccaccatgcctggctaatttttgtatttttggtagaaatggggtttcaccatgttgcctaggctggtctcaaactcctgaactcaagcgatttacccacctcggcctcccaaagagctgaaatcacagacatgagccactgcacccagcccaccaagtttaatcaaataaatttatatagagataaatgtttgcctttttcaaacacacatgataactttataaaaatcgtcctgacttgaaataatagctttttttccttttaaccttttatttcttcttttctgtccaatgatgctgcctgcttctcctcttcccaggtaacattgctagcagagtgactgtatccatctatatctttcttcatgctcataaaatcatatctaaatatatacatatatatgtagatttctcttcctatagcttacaaaaatagaaccacagtttataaatttctctgcatctttcagaaatggaagatggaagtgctctccagtcagtagacagaggtttcagttattcttgttaaatggctgcattatgtcatgatataaatgtactgcaatttactcaataattctactgtctatgggcattcacattgttttcaggttttttcctcccattgcaatcatgatcactgttgatgtgaacatccatagacacatatattctggtgtttttatttctatgggaagaattcccatgcgtgggattgccgggtgaaagaatgtgtggagttgttttcttttgatatacgttgccagattgctctccaacaaggtcacagctgctggcgatgtggtgaagagtgtccctttccagcctgtagtaggtgttatcatgttcccaatttgctagtctgatgtgagtaaagtgataactcattgttgtgtaatttacatttccttaactcttagggagaccgaacatctttttacatttattcaacatttggacttgttcttctgggaattgtctaggatagcttttgatcatttttatgctgataccatttttattctgatacgcacataggtattaaccctttatctgccatctgatttgcaaataaatggaaagatctcatcaagtactaggttgatgtaatgtcacatgttttcttctaaaatggtttcagttttttagatttaagtctttaattcatctggagctcatttctgtctaaatgacataaaataaagtcccaattttatttcttttgtctctgcaatgtccaatacagtagccatagccacttgcggctattgagcacttgaaatattactcttcagaactggaatgggctgtaagtctaaaatatacactgatttccaagactcagtatggaaaacaaagactgtaaaatgtctaatttataacttttatattgatcatatgttgaaatgtgaatgttttggatgcattagaataaataaaatatttatgtaaattaactgtatatttctttttacttcttaatgtggctactagaaaaattttaggccaggcatggtgcctcacgcctgtaatctcagcactttgggaggctgaggtgggaggattgcttgagcccaggagtttgagacaagcctggacaacacagtgagatccaatctttaaaaaattttttaaaaaaattaaccaggcatggcgatatatgccagtggtcccacctacatgggaggctgaggcaggaagatcgcttgatgctgggaggttgaggctgcagtgagccatgttagagacacagcactctagcttgggtgacagaacaagaccctgtctcaaaaaaaaaaaaagacattttaattacatgcgtagcttacattatatttctattggacagctctatttcagatgatcagttgcgccagagctatttcttaaacatttttgctctctttcacttatcttttatctgcctcatgaggggtatatctattttatgtctcatagtagacatctgtcttattcatcacttgccatcatctttgaatagcccttttctgttgggagaaattcacaatcatgagtttcacctctccagggtaggagttagacctcaaattcccaatctctctcacagttaagatatgcatatttgacgtttgtagaatgaattggaagtcagttacatgagggatcaaattctgcatggagtttttatttccataggcgcaggtggcacatgcaaccagctttgatggtggcggttccagaagaggttgcgaggtcaaggccctgcctttggtgggtggtgacagcagtggcagtttctttatcaggccagcactgggtatactttgggcattgcttaaccttgaatctgacttttcagccctcccgataatactgtgagctacttggccaggcatgatggctcactcctataatcccagcattttgggaggctgaggtgggcggatcacttgaggtcaggagtttgagaccagcctgaccaacatggtgaagcccacaaaaattggtcaggcgtggtgatgtgtgcctgtagtcccagctactcgggtggctgaagcaggagaatcgcttgaacctgggaggcagaggcttgcagtgagctgaaatcacgccactctcctccaacccgggcaatagagtgatactccttctcaaaaaaaaaaaaaatactatgagctactcaatatctttttaataaatttgctttctgcttaatcatccaaatcagcttctgttgcttgcaatatagaatcctgactgatatactgggattttttttccttaaagacatagattttggatttattttttcctggtatttccccttactatttctaaaatattatcttccatcttaatgagtttccccttcccccagctaattttcttgtcctttttctatttctcaagaatattgttttagcctggattctctagaaaacagaacctttggcaagtttgtatgccaacacctcactggggagtgcaacctcagagaaaccagattgagggaaaaatgaggcaagaaggagaagtgcaaagataagaggcattactgagaggacccgagttttgtaattaatgaagctaactgcttggactcacagtacatcttcagatcttcagagaagttgtatgaactaccctgtcttggaacatcctcaggaggagaaagtgagtagaatttaaccacggctccttcctgtctcttgtctcatcccctgtggctcaaagtctcccccacagggcattaaccctccagcacattcaggctgtattacctggtctctccagacagcagccggggaagccagagccttccagaccaatctagctagtgcaggtagtagcttgtctctccttttctgacagtgccactgtggggattctccatctatagtgtagtcaatggcagaggcatggacctcgttccatgaccagggactagcttgctgtcccctgtagctctcttctatctaggattgaaggcaaggggtttaggcctgaggttggtgagtatagggcttagggagaagatatcacagagagatctacggcagtgcataccaagtctggtacattccactttgcaccattcagacctactttcaccctcttataatatctggagcacatataagaacgatgccttcatttcgtctcctaggggagagatgcaagtcagtcctccaaggtggtgacttgttgcagcttctggcaattttagagggttggcaaaccaagtacagtttttgctgctgtaacctgttccaggatagtaattccaattcattgtcttcctcctctgctacctattctggatttccctccctcttggctattatgcaactgaaatgggttgcttcctggtggagtgactcagaccttcctcctcaagggatctgagggatctgagcccttgctcttgtctaactgtagttgctgcaaggaatttaggactgtcctttgcatggaagtcctaagagatgcccagggattccctggattctcattgtgtagcagttaccccagctcctcatgttacagggtggattatctcagcaggtaaaaccattctttctttatctgctagtcaactggcatgaatgaccaaaatggccccaaatggccagctggtttgagaggctaatcttacttccagtcctttgctcctggggatatcacactgtatattggccattaattcagtgtatgtaccatattctggaggaaagcacctcatccccaaaaggtgtcgtctccaagctggtaccttaactaaaccttggagaggccatttctgtcagtctgattgcttttgggtgatgatgtatagccttgctacttaaagtttgtgtgtgtgtgtgtgtgtgtgtgcgtgtgtgtgtaggggaccagtagcagcagaagaacctgggagcattttagaagtgcaaattctcagccagctgtggtggcttacacctgtaatcccagcactttgcaggccaaggcaggaagatcgcttgagctcagagttcaagaccagcctgcacaacatagtgaggccctgcctctacaaagacaaaaaaattagccaggctcagtggtgtgcatctgcagtgagctgagctattattccaacagtgcagtctatcctgggtgacagagcaagaccctgtcttaaaaaaaattgcaaattctcaggctcccctccagacctactgaagcagaatctgcattttaacaagattcctaggtgatctgtaggcacattaaagtttggtacctggtttacatggtaagacctatgtgatgttcactgaagcagggcaatggttgatgtcagaggaggaagcgtggggtacagggttgctatggatctgtagcaatacataaactgagtcatatacaagtattaagttcatttattgacaaagttacttaagcctatacaacttccattgactgcagctttttctgtcttccattagcttttgaatgacgaggtctcctttccattgttttccagataatttgtaattttattttttatttcctttgatccaacggttacctaacactgtatttcttacacttaatttccaaatcagtagcatattttggtaatattttaaattatttacttctctttttattggatgatgaatggaaaagatagcctataaaatacctaatttatttaatttttcaagattttccttatgacccaataggaaataaattttggtaaatactccatgtatgcataaaaatctatattcagtagttgaagaaatacttatttgagtttgctgattctatttttaatccttctacgcatccatttttcctattagagctactgactttgaaatagacatgttgaagtctcccatcgaaattgtatttttatgaggctctctttatatttctaatacttttttgctttctatatttatttgctatgtcgtttggtgcataaagttttatgctcattaaatcctcttcttaaattttgtagtaataatatccctctttatccagtttggaattttattcctaaaatccaacccatgtgatgtggatattgctactcaaactttttgtttgtttccagatcaaaactaatttttggatcctgaacacactgagcaagaatatccgttgtggccctgagaccagctgcactggctgggttggtagtgtctccctctaaccctccttttaagtttctcccaggaaagatgcccacgggaatcctggagttgtagctcctggcacctaagtgaaaaagtggctctgtgtggcaaacgggcagactgtagtggacacttggtgtactgcccagattccccctcaagagtgaaggacttatttctatagctgctggcagtgttgccagcaaatagccatcagatatcagctcttttctggaagtgcctgggttgaagagtccaggcttacccaaggtcacgccctctcccaagacagttcatgccttattactggtggacatgaaggcacaaagccccagctcccctcactccaacttgggacaaccctgaagtgccattacagcttcaaagctcctcaaggagatggctgttgcttttattgaatctgtatcacagtccacttcctcactttgcctgatccttcttccttccctttccaagatgttgatcccaagagctcgccttaataaatttcctgcatgcacatctctgagtcttccttctacggaggccagtttatgacaattggaggttgtccttattcttaggggatgtatacttaagagtgaagagtcataacatgggtaatttattttcaaattattctggaaaaatgtgtatgcatatatgtataaaaaggagacagagataaagcaagtgtggtaacatcttaacaactggtgaatctggatgattcatatacggatgtttattgtagcattcttctgccttttctgaggatttgacatttacaaaatatcaaggtgaaaacaaaatccctttcctctatttttaataggtgtttcagtgggaacaaaattaggcttgtatattcaatctgtatctttacctgggacctcttcattatttttaaacctttgttttgtttttctaatacaattatttaaatctgtacaggcatacctggttttattgcactttccagctattgtgtttttataaattgaagaattgtggcaacactgcatagagcaactccaccatttttttctaacaccatgtcctcacttcatgtctctatgtcacattttggtaattctcacaatatttcaaactttttcacgatgattgtatctgttacggtgatttgtgatcagtaatctctggtgttactattttaattgttttggggtacgaatgtgcccatatgacagtgaacttgatccataaatattatatgtgttctgaatgctccacttaccagctgttcccttatctctatacttctctccttgggcctccctattccctgagacacagaatattgaaattaggccaattaatgaccctacaatggcttctgtgtgttcaagtgaaaggaagtgttgcacatatctcattttaaatcaaaggctagaaatgatccccacaagcacaagtaactaaagcaaaaatggacaaatgggtcacattaagttaaaaagcttctgcccagtgaaagaaacaacaacatgaaaagacaacccacagaatggatgaaaatacttgcaaactatccacatgacaagggatcaataaccaaaatatataaggagctcaaataactctataggaacaaaatctaataatctaatttaaaaatgggcaaaagatctgatgaatagacatttttcaaaagaggacatacaaatgagaagcaggtgtatgaaaaggtgctcaacatcactgatcatcagataaatgcaagtcaaaactataatgaagcatcatctcaccccagttaaaatggtatttatccaaaagacagacaataacaagtgctggtgaggatgtggaaaaaggagaaccctcatacactgttggtgggaacgtaaattagaacaattcagaggttcctaaaaaaactaaaaatagagctaccatatgatccagcaatcccactgccaggtatatacacaaaaaaatggaaatcagtatattgaagacatatctgcattcccatgtttattgaagcactattcacaatagccaagatttagaaacaacctagtgtccatcaacgatgaattgataaagaaaacgtggttgatttatacaatggagtactattcagtcataagaatgaacgagatcctgtcatttgcaatgacgtagatggaactggcagtcagtgcattaagtgaaataggccaggaacagaaagacaaacttggcatcttctcacttatttgtgggagctaaaaattaaaagaattgaactcatggagatagagagtcaaaggatggttaccagaggctgggaagggtaattgggagaggggtaggggagtgaggatggttaatgggtccaaaaaaatagaaagaatgagtaacacctgatatttgacagcataacagggtgatgacagtcaataataatttaattgtacatttaaaagcaacaaagagtacaattggattgtttgtaacacaaaggaaaaatgcttgaggtgatggatacctggtttatcctgatgtgattattacacattgtatgctagtatcaaaatatcttatgcagcccataaatatacataactactatgtctccacaaaaattaaaagttaaaattaaaaaaagagaaatgattaagcttagtgagggaggcatgttgaaagccaagaaaggtcaaaagctaggcatcttgcaccaaacagccaagtggtgaatgcaaagaaaaacttcttgaaggaaattaaaagtgctaattcagaacacatgaatgataagaaaacaaaagagccttattgctgatacagagaaagtttgagtggtctggatagaagatcaaaccagctgcaacattcccataaaccgaaaccgaatccagagcaagcccctaactctcttcaattctatgaagacagagaggtgaagaagctgcagaagaaaagtttgaagttatcagaggttggtttatgagggttaaggaaagaagccatctctatagcataaaaatgcaaagtgaagcagcaagtgctgatggagaagctgcagcaagttctccagaagatctagctaagatcactgatgaaggtggctacactaaaaaacagatcttcaatgtagacaaaacagccttctattgggagatgatgccattaaggactttcgcagatagagagaagtcaatgcttggcttcaaagcttcaaatgataggctgactctcttgttagtagctaaggtagttggtgactttaagttgaagccaatgcatatttcccatttctcaagtcttagagccctttagaattatgttacatctctttggcctgtgctccataaatgtaacaacaaagcctggatgacagcacatctgcttatagcaaggtttactgattattttaagcccactgttgagaactgtgctcagaataaaaaagattcctttcaaaatattactgctcatcgacaaaacaccaggtcactcagaaactctgatgaagatgtacaaggagacaaatgttgttcctatccctgctaacacagtatccattctgtagcccatggatcaaagagtaactttgactttcaagtcttattatttaagaaatacattttgtaaggctatagctgccataaatagtaattcctctgataggtctgggaaaaatacattgaaaacctcctagaaagaacttactattctagattacatcaagaatgcttgtgattcaggagaagaggtcaaaatatcaacattaataataatttagaagaagttgattccaacttttatggataactttgagagactcaaggcttcggtggaggaagtaactgcagatgtgatagaaatagcaagacaactagaattagaagtggagcctgaaggtgtgcctgaactgctgcaatctcatgagaagactttaatgagtgtggagttactttttatgaatgctcaaagagagcaatttattgagatggcaactacttctggggaagagtctatcaacatcgttaaaatgacgacaaaggatttagaatattacataaatttagttgataaagcaactgcagggtttgagaggattgactccaattttgaacgttctactgtgggataaatgctatcaaacagcatcacatgctacaaagaaagctttcatgaaaggaagagttgattgatgcagccaacttcattgttgttttattttaagaaattgccacagtcaccccgaacttcagcaaactaccactcacatcagtcagtagccatcaacactgaggtaagaccctcccaccagcaaaaagattacgactcactgaaagctcagatgatcatcaatattttttagcaataaagtattttaaaattaaggtatgtacatttatagacataatgctattgcccacttaattgatgacagtatagaggaaacataacttttatatgcactgggaaaccaaaaaattcatatgactcacttaattgcaatattagctttattgtagtggtctgatactgaagttgcattatctctgagatatgcctgtatatcttcctttgaatgcttcttcggtcatagttcacagattttttattttttgtgccctcattgttattcattagaaataatttataatttctactttaatttttcttttgaacccaatagatagttaaaagagtaggttttgaatattcatgtctataggggttttgttggtaatgaggtttttgtttgtttggctattctttggcgatttctagttttattgcattgtggtctgtgaacacatttctgccatttagaatatagtggaatttcctctgagaattctgcggggatggttgttgaatacatctgtgctgccttcatccttcaatttaaaaccagctactgaaccttttgtgagccaagcagcttctggggtttagagatctagtgcatctctggggtccagaagaagggagttggcagagcaagtttctgcttctgagccccacgacagcccggggactggaggtgcagagcccaggagtaatggtcagaagaaaagtgaaatcgggaacacttgacctacggaaatccaaggacctcccaagggagaggctgcagctgcccccgtgagcactctatggtctcattgttccagctcatacaaagctgtgggggagaacaaaagtgctaaatcctctcctcaactgggaaaatgccagtctttgcagctgaagagactagcgggcagagggagaccttttgggaccaaccacttgccagcggacccagcaagtcaaagactgttgcaacatccattactcgagagactggccttgctctagatccccagcagctgaacatgggccccagtgggtcagcaaaggaaaataccaacccatcctgggggacccagaagtgagaaagtgaaagaaccagcatattgcagagaacaacagctacaaaccttctgggggagagagaggacagcctgaaccaaaaacaatgataacaacaacacgtaaggaaccacaaatacagtgtgcataaacgcacgcatacacacacgcatgcacacacgcgcacacacatgcatgcacacatacacacatgcatgcacacgcacacacgcatgcacacacacacatgcacacacacacacatgcacacacacacatgttctggatctaaagaatctcattttcagactaaaaatttcaagagatgaatcaaaggattgcagagtcactgttgaaacctgacctagaatgccaaatggagtaatgaaacaaaacacaaatcaaaaatgcaaagagaggaaaattatgaggtgaaataaacagtttgaggaaatgatgcaggcaatcaaatacttgcatatttggattattctatgttggaattattattattaggataatagaaatttgtaaaataaagcagatggaagacaggcaataattaaacaaataatagaggaaattgtccttgaaaattttccaataaagacttgatctgagatttgaaggacccactgaattccaaacagaacttacacaaaataatactcatctttagccatgtcctgaaaacaatgactgaaatctcaagtgttaatataaaagcttactcatttctagagagggaaaataagtaacttacaaagaaacaatgagatgtcatttgacttctcatctgcatccgtggaagcaaactatgctgtaagtatatctacagatttctgagagaagaggaatcctaaaagaaagactaatagtaatgtcagactgtaagtcctgaaggatctcagcctagtatttagggaaggggtggaagaagatggaaggtaaaagtgtttcaatatctttgcgggctgaggatatagaaaaatactacaaataggtctctttaatgtggggaaatagatgcttttctcacataatggaggattatataattgcaattgtgtattttattctgaatgtgaaaaaaatacagataaccactcatggcatggaaaagtatagcgcttctctaagaaacctataagaatctataagaaaatctaaaagaaaaaaatctacaagaaaaaaaaaatctaataaatggccatgttaccaagccatcaaaaacaagaaaaagagagaaaggacaaagtaaaataaatagtgaacctgagttaaaatggaagaaatgaaataaattatatccaggtttacacaaacctcaaatgagccgaattctcccattaaaactcaaagttcattaaataggattgaagaacaaaaaccagccatatgctgttgttagaaatactatatcagtcagaattggtgtaacagaaacccaacttacagtggtttaaatatgtaagaaatttaattttccttgcagcagagagctgccgatataggcagctgctcagaaaacctctacccttttccagcttccctcaccctcagcacctctgctgggcttggtagcttacctgatggtgtgaccccaaccttcattcctaagcgatctgagcccttcttggtcaccatgcctctcatgtatgaggccatgatggatgtacgtgtccatttaccatcaaaactgggcacctgatccatataccaagctcaggctccttcctcctctgttggctggtcataaaggacccttctctccaccccatgcagccatcagtatgagctgagagcaagacaacaggtggatgagatgggggtctggttacctgctcacgcagctcgcttatgccatctggtcctccttctgctcaatcctccatgtcccacttctattctggcatgctgctgggcccacctgatcttatgacttggttgatctgacaaatatctgactcattgtggatagttttggctgcacaatcgtttgctttcccgtgatcgggtgttccctccctccggggccaagtagccctcaggagcttgtgatggttaattttaggtgtcaaccggactgggttaaggaatagctagagaacttgtaaagcatcacttctgggtgtgtccgtgagggtgtttccagaggacagtggcctgggactttgtggactgagaggaggagatctgccctcattatgggcaggcaccatccaatcagctggcacccgcatagaacaaaaaaggcagaaacaaaacaaaacaaaacaattttctctctctctctctctctccctccctctcttcttctctctcctggagctggaacacacttttttctcctgcctttggacatcggaactccaggctctccaggctttccagactctggacttaacagcagtctctggacttacaacagcagccccctggatcctcaagcctttggcctcagactaataattatatcagcaacttcctggttctgaggcttttgggcagccatgctactagcaacccagcagttccagcagaaggcctgttgtgggacttctcagcctccatgagcatgtgagccaattcccttaatacatctatctctttctaaattgatttattgatctagaaagattgatcctattgattctgtctctctggataactctaatacagagctatatatcaaagagtgtgtaattctctgatgcagatgacatgacttgctccagaaccctggggatctgagttgtgattttcccagtgagacttgccatatactttattcaatgtcttttctgaccaccaatatctctaataccatagggcctgctaggtcatgtggccaaagcttcaaggatacctgctttgcaggctggacctgctgcagagctcttttctactcttggtgcctctcaaaggcagcagcttttccttttaccagatatttggatcagagcagtattctcatgtttggaatgtgctgcctctagaacccaaagaagtctataggcatggcactttcttcttggtggtgatgggagatgaaagatagaaaagttttgcccttacttttgagggaacgttctagcatgcttcagaacatggaactcaattttttaacctatttggaagtccttgcacttttgaagagtttagtcttgtaccctctgaagtgcttgtgtcttaccaagtcctacatgttctagccacttcacccggtccaattagcatatgtcatcaatagaggggaccagtgtgatattctgtggatgtccagccagttcaggcctcttcatattatgtcatgacagcaccaaacagttgagataacccctgggaaagactgtgtatgtgtactgttgtccactccaccaaatgtgaactgcttctgatactgtttttttgatagggatggaaaagaacacattagctgcattgatggctgcatgccaggtgcccaaggctgtgctcatctgctctagcagaggtaccacacatggcacagaagctgcattgaggccactgtttggcagagtttgcagtagtccactgttatcctccagaatatgtctgggttttgcaggggcaagactggtgaattacacaagctatgagtggactgccacctcagcatcatttaggtttttaaggatggctctggtctctaatattcctctttggatggatgtgacattttaaaaagtgtactcatttggttgggttggggtgttgggggctatttcagaggcttccactggtcttctttactctgatagctcctaccccatgggccaagggaccagcatgggagctgtgccaattgccaacatgtctattccaattggggactggggagatggccatggggttggcccatgggtctagtgaacccgctgtaacccagacttcggccaggatcccatttatttcctgcccttcatatgccctcgatttaatagggaggctacgatgatgctttgggttcctgggtaaatgtcaatctggaccctgtgccaatagttctcgatgtttgagtgttcctctttctccagcgtgtggccatctgtcatggcatcacagggtcctcctaggaagccagcctctccttcaattcatgtgctttaaacactaaaactggttctggtctggaaactaagtgaaggagtgtgacttttttttgaggagtgatcaccctcaactacctgaccaggaatgttaaattgtagaaaatgtgtatcttagtggtcagacatttctatgtataatatgcacaagaaaaagactctctaggcatacagcagactgtcagccatacctacctctctgtggcaatattatgggccatttaactttatccttttttgtttgtttgttttttaagacagagtttcactctgttgcccaggctggagtg[133 bp omitted]gcgggatttcaccatgttgcccaggctggtctcaaactcctgacctcagggtatctacctgcctcggcctcccaaagtgctgggattacagacatgagccaccacgccctgcctaactttattctttatactgaaggagttaaaaatatgccactctggcatagtgactattttgagttaaaggcacttgaaaaacagcaggtacaagaagattgccttgatcttccttctgttacttaaaagcaggacataaaattcccatgtgaaagatgccctccctttaacagaaagaaagtaacattcttatcaaggacaggaaggtgaggtcgtgggaaacctttacacacagacccggttcaactaattcctatcttcctagtcacttctccacctgatcaatgaccctagccccagtacctttgcctcgtcccactttcatgacttatgatactttgtccatttcagtttataagcattcatctctaacagcgtctttgggcctttgtttccttatgaaggctcctgtgcaggtaaaacttgcattaaataactgtgtgtgcttttctcctgttgatctgtctcatgtcaatttcattttcaggcccagttagaaaagaactctaaaagggtaaggtaaaatttttcctctcctacaatactttaatgtatttttcacatttttatattatagcaaatatattctgtcatgccagagattacatatgtaatatgtgttttccatcctctggagagatgttccagaaaattgtcttggcctaactggatgtggttgtcaactccctgctctctgaaggatggatatgaatatttgacatctcttaagaagtcttcctaggaaagaatccttttgaattacagaaagtggctccctcccccagagaggccccactgcctggggaaagagactttaatcagcccctttgttaaaaagtcaaacaaacgcttgccataaaacccagtgattctactcctaggtactcactcaagagaaataattttaaaaaattaatcagatgtggtgatctacacccgtagttccagctacttgggaggctgaggtaggaggatcatttgagccctggaggttgaggctgcagtgagctgtgaccccatcactgcgttcctgcctgggcaacagagtgagatcctgtctctaaaaaaccaataataaaaaaagagaagtgagcacatatgtccatacaaaaacttatacattcatagtcatagcagctttattcacgacagccccaagctggacacaacccaaatatccaccaagtgaatgaaagaataaattgggctatgattccacttatataacaccctctagaaaatgctcactaatctagagtgacacaaaacagatcagtggttccttggggattgggggatgggagggagggagtatgaaggagcaagaggaaactctggggttgatgagagcagagcactggaacttaagttctccctggggtgggggtgaggtgcgtgggatgttttaaacaatgacaggacctgcagttagaactgctgaggttggacagtgtcatgcgtaccccacgttccaggaaagacttatgtgtccctaactccaagtgtgtgacaatgatggtatcttctcttgattcatcttccctcatttcagtgttgctcaacgcttatttttaaacttatagctcctccaaggaaccattttacatttttttttaattgtccacctccccatgaaaatataatactggccaggtgtggtggctcacgcctgtaatcccagcactttgggaggccgaggtgggtggatcatgaggtcaggagatcgagaccatcctggctaacacggtgaaaccctgtctctactaaaaatacaaaaaattagctgggcgtggtggcgggtgcctgtagttgcagctacttgggaggctgaggcaggagaatggcatgaacctgggaggcggagcttgcagtgagctaagatggcgctgctgcactccagcctgggtgacagagcgagactctgtctcaaaaaaaaaaaaaaaaaaaaaaaatatatatatatatataaaatactgcagatatactgtgtgtctgtttacgtactgtggtctcctggagggccacaaatagacgtaacagctaagatgttgggggcatcctaagaaccaatgttcattcctgtgggggctctcttgacctgttgagaaatcatgacttattcccatcagaaaaaaatccaagtaggcagggaaaaagcagtattgtaatgaaaatgtaaagctatctgatttgactctttgatggaagcgtagtgacacacataactgcaaaaaagtgtttcgccagagctatgcattgatgtaggttcatgaaaatgggagcccgaaatgaggcaaaggggttggcaggcagagagctttcaacccaggcagagaagtggcagagtcttttctgtgcaactagagctctctgctgggcatttcaggaacatcctccaataaattgaatgcagcccattcatttagcagctgtttgcccagcatccatcacaggccgtgcactgagagctaggcttgggtttgtggcccagcaaagtttaataactgggtcagaaccacacagtggtgagaagtcacaatggcattcagagtcacttttctctgactccaaagcccacagtcccctcctctggagttcccaagccaggttcttactggctttagaggggagtcccctccctggcctctgagacagaaaggaagatgaggggcaggtaggagtagggtagaagtttgggatatttagggcattatcacctgatgatttcccttttctcctagaagttggagcagaagaggagtgagaatgacttgggttaagtcttgcggtgctggctttttgcaaagggctgttccacaaagactgagaaaaaaactgaggctctgtagaaacagaggcagaagtggcagaagaaaatcttgatgcttccccagtaaattcccatcaattgtagaggttaaagaaaatgtggtacatatacaccatggattatgtagccataaaaaggaacaagatcctgtcctttgcagggacatggatggagctggaggccattatccttagcaaactaacgcaggaacagaaaaccaaatactgcatgttctcacttataagtggaagctaagtgatgagaacacatggacgcatggaggggaaaaacacacactggggtgggggtcaaagggcagaggtgggaagaaggagagcatcaggaagaatagctaatggatgatgggcttaatacctgggtgatgggatgctctatgcagcaaaccaccacggcacatatttacctatgtaacaaacctgcacatcctgcacctgtacccctgaacttaaaataaaagttggaaataaaagaaagagatactcaggtaagactaaaccacacatgaggaattggaaccagggtcctgtgagtctaactcgcatggctcaggagggttggttcccctagggagctgctccttcctcttggtgcagtgtagacagggtgttaggaaagagccccaggctcactgaggatggccaggagtaaacctgccatggctctagaggtccccaaggcaggcaacggatgagagcaagacagtttctcactccaagcgcagcaagcagcatgtgcatctgcagagctgcgctggtttccctgccctcaggtcccacaggcgacgccatgggctcggatggatgctacccactccatgggctgccgtgaagctgtggaactcaaggccaaaggttcagcatactttgagaaagcagcaaacactgtggcaagcagcaaataagccagtctctcccctagggagcaagcagtgacacaggaaacacacggaggtctcctcactcagtgtacaggggcctgcgtgactagctgctagttgtttattacctgtgagcaaccggagacattatgaagacagcctgaggtctcatccaggggcaagggaagaactagccctatagaacagatttaaagggacagtggaaaataaaaataaagctgctttataattttataccatgagtaccatgagtcatgtttggtcaggacatggctgggacagccttgctgggaagcagtgggtgatgtggttcctcgccatggatgagcaccctagtgggctaaggtgcactaagtcagtgcctagggtccacgcgagtagtatccatggaaccccatgcaacaccagtgccaaggaccagtttctcccaggagcaggaggcaagataattattgagacaatctctaccaagatgggatggagaaacagcattctctccccaccactgcctcagcagtgcatctgtgcacccctccgtcccccaagttcagcattcatcctaaagaggaggaggtgaaaggagaaaaaacaattctgactgtgtctgagttctccatctgaaaagactcagaagtctctgaatttgatttagtttatcagtatgggactagattaggccttcttcataaagcagaatgaggatgcagagtcagacatgcagctgcttgcataactagctactagttgtttattacctaagagcaatcatagaggttatggggactgcctgcctgaggtcccatccaggtgcagggcgagggctagccctattgtacagatttaaaggaataatggaaaataccacaccaattgcactcctagacatgtatcccagagaaatgaaaatttatgttcactccaaaagatggacatgagtgtccatagcagctttatttgtaacagccaaaactgaaacaatctagatgtccttcactgggcaaatggttggttaaacgaagtggtgcacacgcactggggaataccactcagtgataaaaaggaaagtcatgttgtggaaagtcattttggggggccatgattttgaaaatctgtattcactacaaacataaggtagatgcctcagtgctgtaggtgatttatttcttttcttttcctcttcccttctccatcccagtagtaacagctaacccacattgtgcgtggatcattgccaagatccctttttaatatattaaatttcatttttagataattgtagattcacatgcatttgtatgaaatgatacagggagatcctgtgtacccttaacccagtatgctccagtggtaacatcttgcaaaacaatatcacagccaagatattgacaatgatacagtcaggatacagaacatgtcaatcagcaccagcatccctcatggtgccctgttgtagccaccctcccttccttccaatcacaccccctctttagctcctgcaacaacttatctgttctccatttgtaaaattttgtcatttcaagaatgctatataaacagaatgatactgagatgggaacagcactgggtggtcgcaggaggatggaaaaactcaaaaaagaactagccaaaggcagggtgcggtggcttatgcctgtaatcccagcactttgggggcagaggcggacagatcacttgaggtcaggggttcgagaccagcctggccaacatgatgaaacccctgcccctactaaaaatacaaaaattagccgggcgtggtggtgggtacctgtagtctcagctactcaggaggctgaggcaggagaatcgcttgaacctgtgaggcggcagttgcagtgagctgagatcatgccactgcactccagcctgggcaacagagtgagattctgtttaaaaaaaaaaaaggaaggaaagagaagaaagaaagaaagaaagaaagagagagagagaaagaaagaaagaaagaaagaaagaaagaaagaaagaaagaaagaaagaaagaaagagagggagaaagaaagaaagaaaggaaggaaagaaggaaggaaggaaggaatcagtcaaagaaacaagaactaggcaaagaaaccatggcataacagaaaacccaaaataagggaaagaaaatggctaaaactctggtcagggtgacaatgtccatgactcttccaggcaaaaccaagtaaggcagaaagagggtaataactggagtgggggggtgtatccctgaaatcccctccttttccaggatattccaccccttaattaaagaaacactcataaaattagacacccaaactccattacttgtgacttattctctcaagcaggctcacacttctctcttaagtgtgtactttcaatttgcaataaaagcttcttgcctttggccttattctgactcatccctgagctctttcttgtgatggtgccaataatctggacaccagctggagctggggccttactggcatctggagaccctcctgagcccttgagcaccaatacagtatgtaacttttttgactcagcacaattctctggcgattcatccaggctgttgcatgtatcagtagctcattccttttgatcactgagtggcattctatggtatccacgcaccacagtttgtttaacccagtgaagggcatctagattgttttcagttttgggttattacaaataaagctgttaggtacatccatgtctattttttagagtgaacacaaattttcatttctctgggataaatgcccaagattgaaattgctggttcttatggttgtagttgcgtagtttttaaagaaattgtcaaactgttttccagagtggcggtaccattttacattttcattagcaatgtacgatggtctcgtttctccacatcctcaccagcatttggtgttgtcactattttttattttagtcattctgatggggatgcagttatagctcattgtgtttttaatttgcacttctctaatggatgttaaacatcttttcatgtgcttacttactatctatatatcttttttgataaaatgtcttttgcccattttctaatttgattttttttttctgttaaggtttgagaattccttatatcagaggatatataataatatttgcaaaccatttatacaacaaagtactggtacattttaggtactagttctttgttatatgaatggtttgcaaatattttctcccagtgtgtagcttgtcttttcatccttgtagcaaggtcttctgaagcacaaaaattttaatttgatgaagttcaatgtttccttttatggattgtgcttttgttgtcaattctttgcctcactatctagatcccaaatattttctcttattttttttgaaagttttatctcttataatttaaatctgagattgatttcaagttaattttaatgtaaggtgtgagacctagggtgaagttctgttctttctctctttcttttctttcttcttcttccttcttttttctttttttgctcatagatgtcttactgttccagcaccaccttttttgttgaaaagactatcctttgtccactgaattgcttttgcacttttgtaaaatgtcagttggacatatttgtgtgggtctatttctggattctttgttatattccattgatctatgtgtctatccatcctccaataccacatagtcttgattactggaaaccgattcctcccattttattattctttttcaaaattatgttagctattccagtgcctttgcctttccatacaaactttcagatgatgttgcctgtatctacaaaaaatcctgctgagattttgatagtgttactagggcagccccagagatacagccgaaaaagctcattattttcttaaacagtagataactgaaaaaactcattttttttcttaaattttttctatttctttatctataggtaagcttgcttaaaagaactccagatggcccgggagctgcaggaccctttgccaattatcagaggaagataaggcctgtgtgaaaccgggacaaacctgaaccagcgaccccgtgttacctttagatcattaacatatcatcataatgctaaaacctcacccatagaagataattgctgccattttctgaatatacattatatgaagaagcatgttcatgatctgcacctgcacatctggagttcctccccatacatgtttacgtacctccctgccccacatctaactccttaaaatcccccagcttctcatatctcagggagaaggagtctttagagaaagagctccctcctccattcctggccaggaataaaacctgcttgccttttttcccaattaggtgttacagtagaactcagttaccctgtaacaataagaattgcattaaatccttatatcaacttgggaagaattgacagctttaccatattaagtcttctaatccataaataagtatgttcatccatttttttagatttttgaaatttctttcatcagcattttgtagttctttgcctcactatctagatcccaaatattttctgttttttttttctgaaagttttatctcttacaatttaaacctgagtagttctcagcatgcaagccccatacatgttttgttggatttaaatttaagtactttggtttttgataaattgtaagtgctactgtattttaagtttcagtgcccatgtgttccttgctggtataaagaaatacaacatattcctgcagtctagctgaagtcacttatcagctctaggagtttctgttttttgttttatttttggtagatctttgagatttcctactttgataagcatgttatccacgaatagggacagttttattactacctttctgatctgtatgccttttatttccttttcttaccttattgcattgggtagaacttctaacactgtttaacaataatggtaagagcagtcatccttgcccttttcctcttctcaggggtacaaccattcagtctttcactgttaagtatgatgctggctgtggagttgttatagatgctctttaacaagttaggacaaattccctctatttctctttttctgagcatttttaaaaccatgaatgggtattttgtgaaatgctttttctgtattgattggtaagatcaattttcttttgtatccagttagtatgttggattatgttgactgatttgtgaatagtaaaactgccctgcattcctgcagtaagcttcgctgtgttacaagatctttggggtgttgcttttctggccagaaacctctgtggccagtggtgcctttgcccaagttttgtttgggctcactgggctcattccgcccactcggcctggcaggctgtgctcagctcatgctaccagcctggaccccatgtctgccaaaggcaagtcaggcatggagtggcaaggggtgtgtgagtgagcgtggggtctggccactgtgcagtcagacatgtcagctgctgcagtggggtgggcagctccaggtgctggcacaggcactagtcctctgtgaggctgtggctgagccaggcacactgcacgcagcttccacagctggtactggggaacaaagtggtgcctggaggcttggagatgccaggaaccacagggctcccaagaaagagtcatagccctggcttggggagctcccaggtctgggcttcccgaagggccatagctattctttctttctcttcaccctcaatgtagtgagcaaggggcatgtttcaaccctgtttgtgttacagctcttttagccctaccattcaatgggtcccaagttcttgtcctataaccaggaagaatgaggtacccagacaagtggagggtgagcaagatgaaaaggagctttactgagcgacagaacagtttggaggaaacccgcagtgggtagctcctttccacagccagggtgtcctgatgagtgttcagctcctagcaaagaggaggccctggagtgggaagctcctctttgcatgcaggtggtcacattgtctctgcagctctcagcagagaggaggccctggagtgggtagctcctctctgctgttggtcatcctaatgtctgctcagctctggttgagcgcaggggtattatgggcttcagaggggggaaagtgtatgccaactggtccatgggcaggcccagaaaaggcaccacaagctcccactctggtctgtggggctggcagcccgacgccagccttcaggccctccctggcctgaaggtggggcctcactggggacctgcccccttctgcccaggagcccatctgcctcctgccactgcacatggcacccaggctgctcacagcaaggggcacctacaggccagggcaagccgccctcaacttcgtcattgtgtatacttttttttacattgttgaattctacttgctaatttaaaaaaatgttgcatctatattcatgatattagtcttttgttttttgtactatcttttttttttggtttgagtatcagatttagtactagcttcataaaataaatgggaaagtctactctcatcttcaattttctggaagagattttgtagaattagtgttaattcttttttaaacttttggtagaattgtccagtgaactctcctggtctaggagctgtttttaaattttagttttaaaattacaaattcaacttttaaaattccatttcatactgggtgagttgtagtttttgaggaattggcctgtttaatttaagctgtcaaatttatgtgggtagagttgtttgtagtattcccctactatccttctgatgtacacagagcctgtagtgatatcccatttcatccttgatgtttcattccgtttcaccctctttcttttctctccttattactggttgtgggaatgggaattccagcttctccctaggcctctactaagacctccctgacttgggggacagttgggtggggcggctcatgactgctccccaaggggcctccactgacacaaggggtggtggcctcattaccactagttggtggtgaaagtcctgatccccctctgggttttctggtacactgccccagcagagcagagaggggcacctcatgactgctggatgggagtggaagtccagactcccccactgtcttcactgatattgcagggagcccatggggagagttggggtgcctctttacagcctggtgtgggtggaattctaggatctccacctctgcctttgcttgtgtgagtgtgggtagggccacagtctttctgtggtgttcggctggagtagagaggttattgtctcaaggttttctgtctcgtaaggctgcccattttctgctttctgttttgtttttgctttgtatagagggagtaggcttttgatggggcttttccccccatctcaaacactagaatttccaggtcgcgagcttcttcagttctaagtctgggatatatgaggcaaaatgaaagccaggagaatgcactatgcggtcccaagtttcctagctggtctgccttcttttctcaacttttcagaatatttttatacttgctttacatacaaactaaatctactgaaaaaatacaataatcaaaataaatggatgggctcaatagccaatagaggagacagaggaaaaaaaaatcactgcactgacaactataactagagaaatcacccagactgaaaaacagagagaaaataaatggaaaaaaatgaatggagcttcagggacctgtgagactatcacagggtccagtgtttgtgtcatcgaacttgcagaaggagaagagaaagaagacaaggctgaaaaggtattcaaagaaataatggctgaaagtttcccaaatgttcagagtttttagttgtccttactgggaggaatagggagaagcgtgtctgctctatcttcctgaaagctaaagaaccaagcactgctggatggggacccagggtctccaagctgagaagaacactgataaggcatgcacggaagcagtcctgggaggactctgccacaggcacaaacaccactggacacccaaagtcatactgctgggcgctggagtccattgcttcttctgagaagaatcgctaacttttctcgggtctttgtacctttagcccctgattcaaagtcttagggaggctcacctaagtggccagtcgcagggagtgtgcccagccctgcctgtcagcaggtgtggaaaggaaatgtacagcattctgcagcatccctggtggaagctggagcctgtcttccattaagccgtactcactgtgggattcctcaatttgtccaattaggaggtcagtgcatgaggttgctgtaccctcatacccccgcaacactcagttttactgaacttcctaatatttgccaatataataggtgtaaaattatatctcattcttgcatcaatttgcatttctgggattattaacatttgtgagcacctctcatatgagtgttagcttttgagagttctcattctgtaaattgcctgtttatatcctagatatatttatgtttactgtgcttctgaatgggagcttattttcctgagtcttacagacatttgagacagttacattataaaagtatattgctgagtgaagggataatcataagacatagttctttaataattccagatttgaaaaacaaccatattaaatgttattatttgtgggaggtgagattatctgacatttgtttctttttcttctcttctttcttcctcttcctcttcctcttcttcttcttcttcttttcttttttttttttttttttttgacagagtctcgctctgtcaccaggctggagtgcagtgttgtttcttcttttgaatggatacattcaactttacctgagctctttgctccaggaaaataggaatggataagaaatgctccactcttgtgtgtttcaggaaatggttaattgcaaaaaacacgccttccctatatggcttagaccgcccttcccttaatgactcccttgtgttataaaaccccaagtcttttttaaacatgtttctaattaatgaacattctctctattgcagtagcctacatacaaccatctccttaattgtcaggtgcatatgtcctacacacattttatttttttaaatataattttcatacataatgattgcagtttctataaacttttgaaaagtactggtcaagtattttgtagaatatccctcaatttgggtctgtctgatgttttctcatgattaggctagagttatgcattttgggaaagaatgtcatggaggtgatgtatccttctaatcacttcatatcagggagcatatgatatccacatgacttgtcactggtgtcattaaccttatcacttggttctggtagtgtctgccaggtctcttcactatgaaggtactattttcctctttccatactctattcaccaaatataagtcaccaagtgcagcccatactcaaggggagggaataaagctcctcttccttgtatcagaatgtgtaaagatctcttaggctttaaaatctatatattattcagttgcttctcctgttccgctttttatttgttagggaaccagatcctttgtcctacttccccacacctaggcttgctgattgcatctctgagaagtcatgcaacatgttcctttgttcctgccatttcatgtacattggtaccagaggcttgattagctttatttatttattcatgatggagtctcgctctgtcgcccaggctggagttgcagtggtatgaccttggctcactgcaacctctgcctcccagattcaagtgatcctccagcctcagcctcctgagtagctgggattacaggcatgtgccaccacacccggctaatttttgtatttttggtagagatggggttttgccatgttggccaggctggtctcgaactcctgacctcaggtgatctgcccacctgtctcccaaaatgctgggattacaggtgtgaaccaccacacctggccttgatcagatttagatgcaagttttgaacatgaatatatggtggtacattctttcatcagaaggtaggtaattattgttgcttcccccatgttttttgagacaattgtttctgagacatctgtagccaaggctggagtacagtggccttggcttacagcagccttgacttcctgggttcaggtggttctctcacctcagcttctcaagcagctgagaccacaggtgtgcaccaccacgcccagctaatttttttgtatttttagtagagacagtatttcgccatgttgcccgggcttgtcttgaactcccggcctcaagtgatttgcctgccttggcctcccaaagtgctaggattacaggtgtgagccactgtgcctggcctcccgctttttttttttaacgttagcagctgttgatgatcattgcccagctccactaatgcattagggattacacaatggtaatatacttattttaacatgatttcttcatttgctggttgtaatacttctggcaagagaaacattcccctcacaattatttggttactctgaggaacggttcatacaggaaaggcagtattcatgattctttccctttattttccggttttcaaagcatcctccaaaggtgaccaatgctttccttttgaatgattgtttttgttgtttttttgcattcccaaaagaaatgctactgattatggttattattctttcagtaccttgttggattctatttcctagagttttatttaagtgtctcatgtatattaatagatgaaattgatttatatcttggggtgacttccagattttacacacacacacacacacacacacacacacacacacacagattgtgttcaaactatttcttattataatctctgtgggtactgaaagaatcatgcatttatggggatgaaaaaaattacctttgagagcaagcattcagtgtacccaataaagcagaaactcttgcataatcacaaataaaggtgccacagaaatttatgggaaatgcggtcttgcattgcccagaggaagtcaccagggacagatgtttagtagctcctcctgcacacatacagttccattttagggaaagaggttgctcttgctctgtctacagccttatgggggagactccacatctttgtccatccaaagtattggtcctaggaaccaaactgaaagtgccttgaaaaggacatttgcatagagattgggggtggaagggggagaatgtcaggtggaattgacttgtgctcctgtaaggtagaaacaacacactgaggaatcgtattaagtgctcccagactgtcctagacttggtctcaagggaatggcaggcaagagaaggccttggtttcctatctgctgggtccagggctggagagtgggcatttgcttccttctctggaacagggtgctggatgggaggccaggaatgtgcatcaaagtgcacaagagatgattctagaaactctgctcttgccaagtatagcctggccagcatgcagcctggtactctaagaggtaagttccttgagagcaactaggaagagcattaatattttgtgctgatttggaagaggcaaggagagtgcaaactgatgtaacgaaggtcagaaatgtagatgccagagacctgtgtgcaagtcagggtctctatgggatctgggcttctctataactccagtaattttttttgagatggagtctcgctctgttgcccaggctggagtgcaatggcatgacatcggctcactgcaacctccacctcccaggttcaagtgattctcctgtctcagcctcctgagtagctgggattacaggcatgcgccatcatgcctggctaatttttgtatttttagtagagacggggtttcaccatgttggccaggctggtctcgaactcctgacctaggtgatccgcccgcttcagtctcccaaagtgctgggattacaagagtgagccaccgcgcctggcctaactccagtaattttaaggaatatctatcagccttgttttcctcatctttaagatgagcatggaaagagaacttatcttgtaggcctgttttggagattaaatgtgatatggcatgcatacctttgcttgcacataacaagatcctaataaaagccattgcttctattatgcaagatactttgctaggttcttttaattaagtgtaccaatgaacatgtttattgtgaggttagtactgatatcttattattttatgtcatctttattttaataagaaaatggatgctcagagaagtgaagccagtcatccaacattaacaggtaggtggcggaagtgctggggttttaaatcccagaactgctttccatcccgtgttgtgcttcgccaatacgccatattgccaaaaacccagacttggatgttaactgtctttgaattcttcacagcactcagccccatgaaatgatcttaatgactccacaagaaataaatgctgaagaaaaatggactccagcctcctaggcccaggatttcttgatgtttctttggtgtttgggaggacactgtatttctgcagcttcaggatggcttatgtactctctggcctgtatttgttcctagcacccctggtttgagtttaccagaagccagtgtgagattcaggggccaatgtgtactatcagcgacaaatattggttatcaggtgagaggtcctgtctaaagtgaagctgtgcttggagctcagatactgactccatgtgaatgcaatggatcttgtgtgttaggaggacaagactcctggaatagaaattcagtgagacctcacaccagagctctaggcaggggtggaaaagccccaggcaaggagctgggctataaacaattcttgatccttctgttcagagtgtgcaaaatttgcatggtgttaccccatgcagagacaacttgggttgtgtgccaatggacgtttcagggcacttctcaaaggagggagctaagctgaggggcttggcagggggcagactccacaataaaaggcttattggatgtctgtgagggtacactcaagacaggagagagtcagcaggcccagctgagaaaattcaatctcaaccttctctaaagacattctctgaagacacatgctttattttccactcattctttcctgatctgagctggccctacactcatattatatccatcattgtctttggcttctaaggatgtgctgattgccctatagattgacatacaaagttcagaacgataaaaatggaaaggcattatagtattatctaaatatgcctcctcaatttaaagattaataaaactgggctagactaggtcacacagttggttagaggcaatgtcaagattagaagttgccccattctcagtgtgctgttcatcattccaaataaaatcaaaataagatatctttaaaggtttctcactagaaatgatgatgaagagagcaccatcaataaaagagacagacgtgcctgaaagctccttccctgccctgccctttccagtttcctgtggattctcaagaccatgaaaggttagaaatattagctgcagagagaaaagaaacataacatgaacatattttcctatcagtggattttcccctacaagatcatttttgaagaagctaatggttaggagcacggcctctggggccagacttcctagactcaaatcctggctccatgtcttactaggtatatgaccttgggcaaattaacctctgtgctttggtctacccatctgtaaaacagggataacagtatctacttcataggttgttatgaggattaaataaccgtttcgtcttatctatatccatctatctctacatagatatatatatgtatatatatcctagaatagtgcttggcatgtagtaaactctgctatagcagagttttctattatcgacaaatagcaagatattctgccctttggatgtgtgataatttctttagccaatcccttactattgtatatttgatggccttcagctttttgttgttattcaaaggaggataaattatcactaaatccatcggaaataaatgtctacactctccaaataatccatgtgagagttacaatggacaggtaggtgccatttccttcctgtttttttctggtagcaaagtaggacaggaaatgtagagtctagttgggtggccatatgccctgccagaattcactggggagttctactattaaaggaagaagggaaccatggctactgcagggctatcagcagaccctgccacagcttttaacatccatcctatcccctagactacaactctgtggaagtttggttaaacaaggtaatcacaggactacccttatgttgtcacactttagtggataaatgtttaaaaaaacctggatctatttttatcatcccttaaatttcaaactccctttgtcacctggttttaggtacatttttttacaagccatacatagttggatttagttttctaactcactgttaaactacctctgtctttgatgtaggaattcaatttgttcatattatttgtgataacatttattgattctttttcatttttacttgtttaaagtctattgtacttttcttttccactttccttactttttctatcttggtcagtgttcactttatcatttaaaaaaatttaggagaaattctactaggaaacaaatggaaaaagacaatcaagaaaatcaagggtaggcctaaatgactactggtatggatacttgtaaaaagtcattaaagagacttgaactacagaaaaacagataaatgtaaaaaaaacttagctgcaattcttactacaaaacatcacctttgttaatgttctaatgcattaagacttttctggaaaatcagatattctattaacagatattcatatggatataaatatgcatatacattatataaataaaaataacccatttaagaaccatgaaggctctcttttctctccctgaatgtaagtccctccttcctcctaaaatgtaactgatattgtagattttgtgttaatcattgatttgctttcttttctaaatttactacttacatatgtatccctgaacaatgtattcttggtttgcttttgaactttatataaataacataacagagtatctatatttttcccttttttaaattcaacatcactttaagatataaccatgttgatgtgtttaacagagttttattcattttcattgatgtatattatttctaccatatgactatgccaacatttattaatttagtttattggtaatcaacatttggatattttctttaaattttttttttacaaaaactattgcaatgttgcagtgaacattcttgtacaaatttgtgggtgcagatgtgcaagagtttctgtaaggcaatttttttgtgtggtgaaactactggtattctggataagactatttcctgtcctttcactgatacattgtagggaaattagcatctctggcctcccatctacccagagcctgtagcatgtcaatgatgtgacaatcaaaacaacagatttccaaacacactttaggaagtccagttgagaattattgttttatggtatgtatctagaattggaattgatggaccacaggttatgtgaccgttcaattttcacttataaaatatattgtattgttgtgttcccatgtgtaaatccaacatacacataatttatgttatacagcacactcgtatcctatgtaactatatatagcccaatatacttcaggaaatcttcacacatattcaacgctatcgtgtcaatgacttaaataattcatagttttacaaaaggatcatgtttcacattctattaagaacaagtcattttctaatcttttctttaattactctgctattacatctgaaagatgacttctacctaaacattttatgcacaagaacattttgcattcatataccttaaaattaatttttcctccacagctctgaatacttgctgaaagctttcacatgttcaaagcattcatgtggtttcactcctatgttaattttctaattcctattcgttataacctacaaacaaatactttcctacatgtattaataccttagtgtttctgccctatgattttgctgatgtttgacaaatttgccttgaagatgcaggtttctgcacatggagggtgttgataatagttttcttcttgtgtgttttcctttgatgtttggtgagggctgacctctggctgaaggtttttctacattcattacattcatagggtttttcccctgtgtgaattcgctcatgttttgtgagggctgacttttcatagaaggttttcccacactcaggacatctgtaggatttttctcctgagttctctgatgcacgacaaggttggatttcacatagaaagatctccagcactcattacatttatagggtttctcaccgtgtgtgagtccttcaatgttgagtaaggtttgatttcacacagaaggttttctcacattcattgcatttatatagtttctctcccatgtgagttctccgatgtactgtgagggctgatttctggcagaaggactttccacgttcattacattcatatggtttttctcctgtgtgagttctctgatgttcagcgtagttggacttcacaaagaaggatttttcacattcattacattcatagggttttcttccgtgtgtgtgtgctctgatgctatctgagatctgttttcttacagaagctttctccacatttattgcagtcataggttttctctttttttgtgagctctctggctttgtgtaagttgtgacttcctacttgaggcaccccactttcattacgcccattattttttttccccaagtgccttctctgatgttgagtgtgtttcaacttctcaaagaaaggtttctcacatttattacctttacagtttttctctcttgttttaatcttgttttaattctctgattgggagtgaggcaagattccttcaagactctttcactatcattacacttgctgggttttcctgttgtgtgggttctctgatgttgagtaaggcatgctttttcatgaaagaatttcccacatttcttacaatcatagactttctctcctgcatgagttctctcattttgagtatggtataacttcttcaaggctttctcattttctttacactcatcaggtttttctcctgtgtacattctttgatgttgggtaaagtttgatttcttgctaaattttccaaattcattacattcatagtgtttctctccttcatagtgttgcccgggcaacactgcgagactccgtctcaaaaaaaaaatactgacaatacttgtatagtagttactatataacaggacttgttctaagtactttgtatgtcttccttcatttaacctttaaaataaagccaagcatagctactattatgacttccatttcatagaataggaaagcgaggggaagactgagcaatgtggtggagctgggctttgaacccgggcaatccggccccagatccattcacttgagcactgtgttaatatttttcacttttaaaatgaggcacaattacataaccgctgaaaagcttccccgtactcctataaagtcaagagtaggtagtgggtagcatgtccctaaattccagatgtggagatgggtggggtttgagggctctgcagaaatctaggaagaggggttgaagaattaggggcatgggaggagtttccgagaggagtggtgatagtatcttccccgtcatgcgcaccaggtactcacctgggagttcctcctcccccgcagccggcctcctgcccaccatcctcagtccagctcgccatcctcagcccagctcacctctgtcctgtgacagctggcccacaccttcgttgaccgacggttcttggcaacctccgacatgatgagttattcagggcggaagaatcgggaattgcttcaagagcaagcgcttacagacttgcctgttttcccagacgtccttggtgcagctgtgtgcgttttatcagagggtgggaacctcccaggcgagattcctgcttctggcgtcccctcctcacaggagcagggtgaccctggctggggagagagggaataaattcagataactgggaccttcagccggttccaactctctcttggagttcactatctcctacaacagaggctttcagtgtggaccctggactggcagcatcagcatcacctgggaactaaatagaaaggcaaatccttggggctctccccagacctactgaatcagaaacgctgggtgtggggcccagtcgtggggtggggtttaacaggcccttcaggtgatacggatgcatgcgagtttgaaaaccactgcctgcaaatctcccttgggaacctgagaactgtggagggcacaaacagatggaccttgagtttcccagaggcctcagttacacagtacccccagggttctgcagagataccaagaaatctccaagatccttaagggaaggctcagtccttacacactccggttggcccatagagacatgccactctgctaagtgctgtgaagcatgcgatttggaaataaaactgaggcttgcatcccagatccttcacttgctagccatgtgacttcacctccagagtcttggttttcttctcagttaaaatagggtgggtaacaccgactttacagggggtctttgagaatcaaatgacacaccgagtgaaaagaacagtgggaaaggcaggccgcatttccagagtgcttagaaaatgtcaggacctgtgcggagtgctttagaggtgctctcttattcaacactcagaacgaccctgaagcaggttttagaaataacttcattttacagatggggaaattgagtcttagagtttaggttcatcactgtgttcatggagagccagtgacagacctaggatgtgaactcgtcttactttcaaactcaggctctgcatctgcaataaggcttgctaaggtaggaatgatagtacagcataaagtaaactttgtaagaattgttctcatccccgctggagtagtgggtttgaccagctgatgaatggttgcccagggcacctgcgagttagaggagcttctggaaacagctcttttaacatgtgaatgccttttcccggagccctttattctgatcaggaaacctgttccctccgcccttatcttcttcgtggcacctgcagatccgcagcggacctcctcctccgtcacttgctttctagacggacagatgcagggcagactcgggaacaagtgccagagggtctcaacccgcgtgggatttgcgcaagtttttgcttccacaggctgtgaacacaaacctaccccaagccccgcaaagcaaccctccaagctaggctctcacctgcggagcgcatcgttagtgcagcacctggtcgctgagttacgcgtagacgcggaggctccacgctgatcagagacaggagtaaggaacaaggaggaagtctgcacatgcgcagacggggctgccaaagaccggttcccggggccctgccggggcgatccatcaacttccagactccgtttcccacaagtctccgcgcccccttccttaaggaacgtctgaagagtttctggcttacttggcaagttgggggatttgtggtccaaagtcatctttacttttatttggagccctagttcctcataacccaccaggtaggagatttgcatgcactccacttacaatcagtgtcacttcagaggcaaagctaccgtgagaaggaaaggagtttgtcaactgcacatctgaaaacaaaattaatgaaagccaagcaacatagtggaatatttatagaaaataaagcaaagcaataagtaaaagattaataaccacgaccagaaagctttttccgcagaatgcaaatattacctccacctgaaactggatttcaaaagtaaaagcctcacataatggcaaatacacataaatcaaaggaaaatttcatctaagaagcacactcagaatctccccttccagagatgaccatggccaatgttagatgatattgaaatgggaccccaaaatctcaatgagtgatttgggtcttttcattgaacatgttgttaataattttcttacccttttacactttttattttgaaatattttaaacttacagaaaagtttcagggatgattcattcggatcatctgtaaaccatttactcagattcatcaacagcaaatatctgcctccccaccttctgtttctctcctcatcctcatcaccatttgagggtaagttacaaatatgaactgtcacccctaaaactttagcatatatcacctagaacaagggctttttaaaaacataaccacaattatcaaaaatttttaaacataactacaattatcaaaattgtttaaacataaccacaattatcaaatccaagaacttaaacagatataatattattatctaaaatctagaccatattcaaattttactaattgttctaataatatcctttataattttttttctgatccggggttcaattgaggatcatttttacgcagagttgccatatcatttagaccactttaatctagttccttggcctttctctgtctttcaagacattgttaattttgaagaggacgcatcagtttttttgaagaatgttcctttatttgggtttgtctgagtgtttcctgataatttgattcaggttatacatttcttggcaggaatcctatataaggaatattgtgttcttcttggtatatcatgctaggtcagtgggatgatgtcagtttatcccatttttggtaaaaaaaaaatttcgcacaagtctcctttattaatctacccttttggtaacaattccttgatcacaaatctagcacaggtagccaaaagatataaagtaccacagactttgtattgactcaagttggatgatgacttttacactaaaattaacacatactgaagagataaaaagttctcaaagtttacacacgtataggaatacaaactgaatacagtttttaaataaaagatgattacttttcaaattatttaaagggaagcctactttcaaacaccctaggaacaagccactcaacactacgtaaactcagaagagctctgaaagagtatttttccaccagcaaaccaaaacacacaccaattggcagtagacagaggcaggtcttctgactaagaaatggatattatacaaatgtatatttacagcataattttacttcatgtgaataactgctaaagcatgacaccaggccgggtgctgtggctcacgcctgtaatcccagcactttgggaggtcgaggcgggctgatcacgaggtcaggagattgagaccatcccggctaacacggagaaaccccgtctctactaaaaatacaaaaaattagctgggcttggtggcaggtgcctgtagtccccactactggggaggctgaggcaggagaatggcatgaacccaggaggcggatcttgcagtgagccgagatcacgccactgcactctagcctgggccacagagctagactccgtctcaaaaaaaaaaaagcatgacaccatatgaagtaatggtaaataattaaaagcttatttaatgaataacataataaattgaaactaagaaatgcaaaactaaaatggtaatagaaaaataaagaatttaataaaacactgttagaagaattacaaaatactcttctgaatacctgctatgaaattatctatacccatgaagaataggcattttccaatattaaattggtgcattgtggtcatactccataaagatactgaaaagcatcatccgtaaaaattttttttgttttacctgggaaatgtacttcttacaaaagggcggctgcaaaatacagagactttggcaactgttagtccaaactgcaccattttgtaagccccgtgccatttcgcagaccttggtcaaagtgaaacactccacgggggttcgggtcatgagaaatattcctatcataccctgccgggcaagggcccaactgaagagacatccctatcataccctgctgaacaaaggtccaaggaacatcttatcacatcccactggaaaaagggccaaactgcttgaccacaggtacatcttatcaatatcctgccaggcagtaagccagatggcccagacccctcctgcccatacctataagtaccccagcctgtaagtggtggtagactctggctttaagctgatcccccaactctgcaggtttttgcaatatgcctgtgttgctgttgagccccactctctctgtgtgtctttctttaaccctcaccttcccttcaaaaccaaacagcaacaattacttgtttttttcttaaagttaaagaatgagtgggatccaaggaacaaaatggtagaccaggagcaggtccaagttattttcaggaaacagagcaacaaagcacaaaggcaaaatttccaatagaaattcttttaataacttagcttgtctctgggattaccgtctcctcccctttagcagaaaagtgtgacttattactgtaggccaattactccactacagtaaacaccttagaatgtagttttgaatcacatctgtctacctgaaagatcagaagtggaattacgcaaatacccacaaaaacaaacacaaaaaactcaacaacaaaacacctcgaatggtgacaaaggtttttcaaaaagtgcctggactagaaagcctagattgtaaacagtaaatacaattctgtatccaagccccagtttgtgttaatatgtaggataaccagatagttttaactctatggctaaccccatttctttctttatatagacaggcagagctagcactgctatattaacaactaccaatatactgctttgtcctttaaaatctatctgccacagaaggcttaaaccactaaaccaagtttctctactaaggctaagaatactgcatctatgcagggatgagaggcttatcacatactcacactcacacacaccaagctcttgggagtcaacttgcaactctgcattgattttatgcccctctatcttttatttacattctttctcaattttcctatcattcaaaacatggtagggccgggcacggtggctcacgcttgtaatcccagcactttgggaggtcaaggtgggaggatcagctgaggtcaggagttcaagaccagcctggccaacatggcgaaaccctgt[133 bp omitted]tactccagccagggagcctgggtggcagagtgagactccatctaaaataaacaaacaacaaacaaaacacacagtagaaatctcaacacattcacaactggttctggttacccagtagtattacttgtgtacaattaagcaagagaccaaaaccacagagcaagttggacagggtgggaattacagggtagggaacagatataaaaacacagatgtgcagatttcagcagaaacgtcaaggatccacatcctgtgttggagcagaaggctctttagaagcgcatatcccttcacccatcactcctatccttggaccccaaagcagggccgcagcttttactttcaaacccagggtcctcaaaatgagcgtgcaaagtccataaacacaatctggttgaaaacagatgacacaacacacctacacgaactgtctgactgttaaattcatgttacaaaacactaacttcaggatttatttttgaaacttttttccacagagaaaataacacactccttggggaaaggtcacagattgagaagacaggccctaggtaaaaattattaagacagcacctggagttgataggcctgcctaggagagaaacatgggcactgtcacaccaccacaggggactgctgctgtctgaggtcagcaggccagttcacatgccacgcaaggtggctactgagccaagtcataaaaatcttccagatcatcatggaacaagtcccactcattttcaaagtctgtcagttcatcgtccccatctgccaaaagcataagcaacatctcacccagctcaaaggtgacaacctcttcttcattgttgtcaaaggggtcattgttctctctttcctcaatgagctccgagaagtggttccttcactgggcccagtatctgtttgcctgtctctgtgtatcctttctatggccatcagggaatacctgcttgtaaaaacacatcccccaagatgggcagctcccctgtccttcatcaaaatccctgcacgcctggctgctcattgcctccttgactttctggatgagtttctgcttctcttctttctcccgcctggtactcactgggaatgacaaagttagatgtgatccggcattctgggtaggacactatgatcttgctctcaaatagcttagtgcccttccacttgtgaatatacttgagacagtaggcgtggctgcagctggagaggatcccaaagccacgctcactggggctggctttctcacagaccacctccatgcagatcccacacatcgtatccttgctgcactgcacagcaaatgagagctccgtttccttctcatgggcctcaggacaagatttttatatgctgtggtctctgggcagcatccattggaggtaggacctgcagcttacatgatcacatgactctctgtggagatacacacagttctacccatttccatctctcccactgcagcctaggggcaaagcagcttgttatcacagctgtttgctctttctctgattctcccttggtcactgcagaaaggggcagtgtacgctgcagtagagttgcccaggaacaaactcaacagcatctacccagtcctctgaacccactcctacagttgcaaagtttgagtctgactcagcttcgcctgtattcatttccacaagcggtccaactatgaatgagagacttaaggaagcagcaagggatgattttgtagttagatctgtagcagttgcttgttcgtttcagtggcttgctgtgttcacatctgcagcggcctccataaacacagtaccgtcgctgaaaatacttgcccactacgccatgtggactgtcagagagggaatgcaagtagcgacagttatgtccttccttacaaatcccatgcacaaaataccagcaggtgacctgtttagttcagctgttgctgcagctactgccactccttcttcccgtccccagggatgggggtggtgactgtgggatggggtgggatagctgctgctgcaggtcctgctcctgatattgtggctgttgttctgggagctgcagcctccactgttactgtttatcccacatacccatttttggtaaaattaactgatcccatggttaagatgatatgtaggccaatatacttttatatcaattgtttcttttctgccgatgatgatatgataataataactttaaaacagtaagctccagccagcacggtggctcaggcctgtaatcccagtgctttgggaagccaaggcagcaggatcacttgagaccaggagtttgagaccatcctgggcaacataatataaccccatctctaaaaaaccaaaacaaacaaacaaacaaaaaacactagaaaaaattagctgggcatggtggtgcacacctgtagtcccagctacttgggaagctgaggtaggaggatcacgtgagtctgagtggtcaaggctgtagtgagctatgatcgtgccactgcactccagcctgtcccagcactttgggaggctgaggtgggtggatcatgaggtcaggagattgagaacatcctggctaacacggtgaaaccccgtctccactaaaatacaaaagaaattagccgggcgtggtggcgagcgcctgtagtcccagctactcaggaacctgaggcgggagaatggcatgtatccaggaggtggagcttgcagtgagccaagatcgtgccacttactccagcctgagcgacagagcgaaactccgtctaaaaaaaaaaaaattagaatatgaaaaagatggaatttctggggaagagggggaattcatgttaggaaactagaggtgttgatgggagagaggaagattatccgtctagcacatataccctataaatttcatgtagacttttggctcaacatttttaacagtaaaccaataggaatatagagataatataaaaaaattttcttatctaatctctaggtaagaataccaagccatcaaaggcagtggccacaaaagaaatgactgccaaattttactctaaacaaatttaaaatcttgcttttagataaaaacaagtaaaaacacacttagaaaatacatttgttaagtatatgaaacggtttgttgacttcatttaattatctcttacacatttataagaagattacactaccataaaaatgatctatgaatatgaagggtaggtaataaaagggaaatgcaaatgaagaataaatatgtgaaaacagcccataaattacaaattaaaaatgcaaatgtttatttatttatttatttattttattttttgagacagagtctcgctccgttgcccagacttgagtgcagttgctccatctaagctcattacaacctctgcctcctgggttcatgcaattctcctgcctcagcctcccgagtagctgagattacaggtacgcaccatcgcacctggctaatttttgtatttttagtagaaacggggttttgccattttggccaagctggtcttgaactcctgacttcaggtgatctgtccacctcagcctcccaaagtgctgggattacaggcatgagccactacaactggccaaaaatgtaaatgtttaaatacactttttggcctttatataaagttggcagattataaagaaaaatgatatctaggatgggtatcagtttgggaaaatgttaattctcataacttttttgaatataatttctaaaacaaatcatgtttgttggaggccactccacaccaagatttaaaatgagcatgcactttaatagactaattctatttctattaatgtgacctaaggaaatagttgtccaaaatatgtgtgtaggtatatttctcacagttcatgttaacagcaatacactgtaaaaaatctaaatgtgaaaaaaggataaaataacttgtaggaatctataaggtgagatgttaggtacccattaaaaattataatgcaggtgtcttcctgctggcaagaatataaaagaaaaaatatacaatgtagggatattctaaatgatatggctggagtttacaatatttttaaataaaatgcactttccacacaaaaataaggcattttttgggaaaaataacgcatatttcctaagggtttaaaatatatgtaaataccaaatacagggaaaaaaattgaaccaaaagaaaaattaaaaatctgcttcaccctcacacgtaacaatagtacagtctatgccaggattttgtttacaaaaggcctaggaaaattcaaaacctgtgtcattcaacactaatatccccctaggagtagacatggaatggagaggaggcattctcaggggcatagatttacatcctttgtggaatatatgtacgctaatgctgcctttttaattttctcagctttagctctgatgttgtattgagtcttctccactaaattaactgcacagtgcattgtggtgtttgtctaagcgtttttgtagtatcttataacatctaatttccacttcaaagtaattgatcttcatgaatttttttaaaaccctctaaaagctctactatttaatgaatatttggatgagactggtgtagtaattaaaatacttaacattttaataaaagcaaatgttagcgatccacgttacataatcatttagaatattctaaagcattagtaacaatgtgttcatcacaggacactagtagtcatggatttgattgttaaatgggtctattttagtttttaatgctaaagtgatatggccaagtgttactgacataaccaaagaacaattagtgttctttactgcttataagtgatatgactcctcacaaattttggaaactttgggagatctgtatgatattgaaatttgtacctaatattgatgtagggcaggcaagcccccagattagggcttagcctgggacagtttttggtgacctggtggtgttggacagtaacttttactgaggcggcggtgcacgacagcagcagaaatactgcttgtagagtggggctccccgataggtggtgtgtccagagtagcagctcagggacacttccgcagttgtgtttacacccacattttttttttttttgagacggagtctcgctctgtcgcccaggctggagtgcaatggtgcaacctcggctcactgcaacctcaacccccaggttcaagtgattctcccacctcagcctcctgagtagctgagattacaggcacccgccatcatgactggctaatttttttttttttttggtatttttgtagagacagggtttcaccatgttgaccaggctggtcttgaactcctgacctcaggtgattcacccgcctcagcctccgtaagtgttgggattacgggcgtgagctacacccccgggcctatacccacttttaaatatatgcaaattaacaggcagattatgcagagatatttagaaaaagggtggtaatctccaggttgtcaggctgttgccatggaaagaggctgtaacttccagtgttgccatggcaacggtaaactgacatggcactcacgggtgggcatgtcttatggagaggggcttttgcttcttccctgttttagctagtctttaacatggtctgcagtctgacctgcctctggagtcgaatctcacctcctacctcaatatgagacataattactaatatgatcattctttggtatcatttcaaatttgtataattgaaattcctgtactataggtggcactgtactaggtattttctatagtttcatttgaaatgtatagatgtaaatacttggaaagaaagtcaagaacaatacacgctgacctgatgacagtactgatttctctagagaagatcaacttaaatgggacttattgctaatattttactttttttatcaacaaaaacatgtactcattttatttgatatataattaaaaactgaccatgtgaaaataatggtatcagtagacaacactatacctgtaataagaaaaacccagaatcataattgaaaactatcccccaaactgggagggagccaagagaccaaaaagtgagttaggcaagtccagtttggcaagtagatgagtttattaggacttacatatgaggcactcccggacggtagcaggacacctttagagatccaccccgcctcccagccctatgctccttttttttttttttttgagacggagtctcgctctgtcgcccaggctggagtgcggtggagtgatcttggctcactgcaagctccgcctcccaggttcacgccattctcctgcctcagcctcctgagtagctgagactacaggtgcccaccaccacactgggctattttttttttgtattttttagtagagacggggtttcaccatgttagccaggatggtctcgatctcctgacctcgtgatccgcccacttcagcctcccaaagtgctgggattacagacgtgtgccactgcgcctggcccctaagctacttttaagcaaattttctggctctttgccgactgtgtgtgcaatgagactgttttcttgtagattcttagataccctctgggatgcttgggttcacagggacacctgctccttggctgggcaccatgaccttggctcattggctcgccttcagggttcaggcagcagacatacacccttaagcaaactgatgggggacccatcacactacagtaccacacttgcttaaccatattatgaatgggttggagaattctaagctgtcttttcccttggctggtgacttctcatatctcatactcacaattgctacccttaaaatagggacaagattcatcccactcaggcttttgtatttaaaatagtagagctcccagagctcctaggacaatacccacctaataaaaaataggtgctccataaaagacagttaattttaacttctctcattttacagagaaagaaactagggccaaagagggacagtgagtttttcaaggccctacaataatttttatgagctgaggctgaagcctaggtcccctggctggctgccaattccctcccactaggagatctcccaccaccccttattggctccatctttcctcctcctactttgccttccacccaaatggcccttcaagtgaagcaagcactgattccaggtcttggttgtctccttcctttgtgtgctccattgaggtgaccaaattgctagtgatttcagctgaaggaaactaccctgagatgtgaggctttctgtgggagaggcaggagggatgccttatggccaatggagtctagaacacaatctcaaggtatactgcaggtgggaatcactgtagccattttatcagagaggaacgcgagggacagagtgggttgagacaggtccaaagataaacactatatttttatgctaattatattctatctcttctttacactttaaccacccaagcatgcattcataaacactccattttacgcatctgtaaacactctattttagctttgcctgttacttgaagtccagataaatggaaaaacactttataagttcccttgtgtctatgtttgtgacatttgttcatgctatcatgtttagcatgttatttttattactgtacaatatttcagtatatgagtacactgccatataattatccattctacttctaatggatgtttgaatttttccagtttatagacattatagtgctgctatgaacattcttgtacacaaattctggtgaacaaaagcatgaatttccataagatattacctaagactgtaattgctaagttatagggtacagatatcttcaattttagtagataatgctaaaatattttctttctggaaattgtaaaaatacactcttcaccaacaatgtgtgtgattccagttgttccacattcttgccaaaacttggtattgtcaatcattttagttttagccaatccttttaattttaggtggttgtgtggtactatgtcattttgggattcgatttctcataattactgatgaggctgagcaccttttctatacctattgtccattttgatattgggtgtgtgtgacgtgcctgttcaagtattttgcccatttttaaaattgggttgtctgctatcaattcaaaaaggttttgtgtatatacagtataagaatactgtgtcaggtatatttattaccaataccttcttccattctttggcttgcctctttcactcttttaatggtgtcttttgaggaacaggagttcttaattttaatgtagtcaaatttatcaatcttttcctttctggttaatgtggttttgtcctatttaagacaccttttcctacttcaaattcatgaaaatattgtcctattatatcacctaatgctttgttttacttttcacaattagagataaattcacatgggatttatttaagtatacggtgaaaggtagatttctttctttctcatataatttcccacatgactcaacaccatctattgaaaagatcattccttccccactgctctgcagtatggcttttttcataagctatataggtttatttctgggttctatattttgtttctttcctttaattatctgttcttatgccaacaccatacttaattactgtaattttaaaataagtcttaatatctggtagtataagtctcttaactttgttcttcaagattggctgggctattcttggccatttgcatttctaggtacattgtaatgttaacatcaatttccacaaaaaagcttgctaggattttgacagggattgcattgaatttatcaattaacttgtcaaatcttgacatctttacaatatttagttttctaattcatggacatagtaatcactacatttatttaggtcttcagttttcctaagccctccaagtgtccactcatgtctttccagcataatagccaaagtcctcactttgacttatgaggccctaaatgatctgtttcctgttaactcttttgactttctcccctgctactccaccccttgcggaatatagtccagctatggtggcctccttgctgttctagaccctgaggagacagcagtgaacatatgcaaaaagctctccccttataaagttccccattctaatgaggaaacagataataaaccatatcaataaataaaatacatagtaagttaaatggtgatgtgtagtagagaaaaacatatacagtagggagaagaaatatgaaatggcaggaggttaacattttagactgagtggccaaggaaggcctgagaagatagcttttaagtcgatattttaagaaagccagaaaaatagccatgtggattccaggaggaagggtctcccaggcagagaaatcacaaagtgtaaaaactctaggacggcctaaatagctccttgtgttcaaggattggtaagaaggctactgaagctgaaaaagaagagggataaagggttaacaggagaataggtcaggtaggtagggtctcataaggaagagtgaagatttaggcttttaatctgggtcatgtgggggccaccagaatacttgagagcagtgagtggctctgtcttaagggcagggattgccctgactgcacgggggcaagggtagaagcaggaatccagatgagagacgacggtggcttggaccagagttgtgtcagtgaaatcatgggaagaggtcaaattcttaatatatttggcaggtaatctgacaggatttgttgattactagatgtggatatattagaaacagagaagtcggggttgacacctcagccaaagcaactgatttaattcttttggtagttgtagacctattcatattttctatctctttctgcatcagttagtcaattttagtaccttttattttctaaaagtttatttatttggtccacttttattggcataaattgttcatccctctcttttataacattttaaatgtatgcatcatttgtaaatcttatttttatttgaaaagattcatttcttctgtttatcaggctaccctcgtattccaatattcattatttgtaccttttctgttctaagtaagtttcattagtgttaattttattagtctttttaataactgaattttgactttgttgcttccttgcattgtatggtttctatttcagattgctatttggtatttctttgtttatactttgttttgctgttccaacatcttgagataagtgcttcattattaattttttcttgtattcttttcagttgtatgcatgtaagatgataaacttctccttaagaactgctctaactataccttgatagacagttctttcttatgattcagttcaaactatccttttatttccttcagtttgataacaatcccattcaagatcatttattcttcatcccctcctgtcctcactttcccagatttcaatcatgcatttaaaaatggagaacatattatctaaatacagactcctagctgctaaggatttattcatcaatgaacaagatagacaaatcctgctccctcatggagtgtacattctagtgaggaagacaaaccagttacaaatgtacagggtggctataaagttgggaaacatgagtaaatatttactttatgtgagcatgttttataatcaattaatacctgcacttgacagggtaggggaaggtcacccaaagtgagattgtacgtgattgtatattgggattgtatgtgaccccattatgccagaatgcagagggactggtttgatgattaattttcaaagatggattgggtgatatggccacgtggaattggctgtgcactctccagatcttaagctcatcaattacttcttctgagggatgctaaatgcactggtgagtcttgtgaaaatcagagtcaaggccgggcgctgtggctcacgcctgtaatcccagcactttgggaggctgaggtgggtggatcacgaggtcaggaattcgagaccagcctggctgacatggcgaa[140 bp omitted]gccactgcattccagctggggcaacagagtgagaccgtatctcaaaaaaaaaaaaaaaatggaaatcagagtcaaagcacactgaaccacacattgctaactagggagaagaatttgaatatattgtaacatcagtaaacaattatatatatgtatatactcacctatatccagaatgtatggccaccatgtagaccgatgaggagtcaatagccagaataatcagatcatgctgatccaaatccacatctgtaggagtttaaagtcttatatagaggcctaccacctctgcaagatgccttgaagtctttttgctcaaattctccctttgcatgttggggctaaagcaaatctagaacaaagaattattgttaagactaagtgtaaagtatgtgaagtataaagagcaaaatgctaaacagacaaagtcttcaatagatacaataattgcataatgtattgctctttgggggcaaatcagggtgcaaataatttcaccaattggcataagcttctatcaccttggttaaattaggagctatgataacccccatcaataaatggtagtttagtgagagagacagagagaagagaagagggggtgaagggacagaaaggaacagaaacagaggcacagatagattatcaaagttgacaggagcttccagtatcatccagtacttattctcaccctgtgatttacatgccctaaggaaactgtgggtctattccaacaagtaaaggaaaccacaggatttacttggcatatctccttggaggataaattgtacttaatgtcacataataaaagccattactattctatgaaaaatataaatatggagtaaatcacaaaatcattcattttaaaaataaaaactaaccttttcagcaaatggtgctggagcaattgggcatccatagacataaaaaaccaaaccttgacttaaacctcaaattttatacaaaaacgaactcaaaatgaatcatggacataaatgtaaaactataaaacttttaggaaaaaataaaaatctttagactggaaacaaaaacatgatccataaaagaagatatttataaattagacctcatcaaaattaaaaacttttgctctgtgaaagacaagtgaagagaatgaaatgacaaactacaaagtgggagaacgtatttacaaactacacatttgacgaagggttggtatctaatatatacaaagacctctcgaaactcaacagcaaaaaaagaaaaaaaaatccaattagaaagtgggaaaaagacatgaaaggacatttcaatgacaaggatatacagatggaaaataagcacatgaaaagtgttcaacatcattagccagtaaggaaatgcaaattaaaaccacagtgtgatatcactacatgcctatcaaaatggctaaaataaaaaacagtaacaccactacatgctggccaggatgtggtgagactggatcactcatacattgctggtgggaatgtaaaatggtacaatcactctggaaaatagtttggcagtttcttatgtgcaattcctctacaacctggcaattttactaatgggcatttatcccagaaaataaaaacatatgttagcacaagaacctatacactaattttcatagtagcttcatttgtaatagccccaaacaggaagcagctcagatgccttttaaacaaatggcatacatccataccacggaatactattcagcaataacaagaagcaaattatcaatacatatagtgacttggatgaatctccagggaattatgttgatgataaaaaccaatcccagaagttatatactgcatgataatatttatataacattcttgaaacgataatattttagaaatggagaagagattagtagttacctgggacaggagagagactggggaggcagtgggtgtggttattgaagaagttaatgtgggtaacaccagagatcctggaggtgatgacagtgttctgtaacatgacaatggtggtgaatactagaacctacatgtgataaaactgtatagaattaacacacacatacaaatgaagtaaagctaaggaaatatgaataagatcggagaattttatcaacctcaatatcctggttttgatattgtactatcattttgcaagatgttaccattaggcaaaactgggtaaagggtatatgagggctctattttttcttgcaactgcatgtcaacctacaattatctcaatacaaatgtcaattatacaaaatagaagttagatttaatgtctttcttttttatatgtgcagtctcaggttatacctgcagaaccatatacttgtattatgctgctgacaaaaaagtgtgaaagaacccaatgccttcattttaaagatgagtcacataaaggttaggcgactatccaagctgataaagcttgtttatattaagcatttatcatggtttctgcctttccataagttataatgatggagaattttatggcaatgttaagacgtccagtcctgggttcagacaactttgggatatatcctatcaggattcaaacggtctcaccatgtgatcttagaaaaataatgtttgcattttctactcattgaaatgagataataaaataatcccatacaccgatgggatttcaagatactgaaataaaataattcatgctggtacagtggatgcgtgataggagactctcaaaataatgcctgttttccggcatattaagtgctggacactagagctaaaggctttgaatacaaagagataaaaggtacagcttctgcttccataaacagagtctaggagagagaataacacaaagataattgcacagattaaaatgtgaaaaataggagagtacagggaattggtggttgatgaggctggataagtaaatgcagcaggtgaggaaggcacctttttaggaatccacactttggctaggtttatgtcatcaaagagcctaacagcctgtttttttgttttttggtttttttttttcacgtgacaggatcttgctttattgcccaggctggagtgcagtgatgtgatcatagctcactgctgcctcaaatggtggggctcaagtgatcttctcacctcagcctcccaagtagcctggactataggcacatgccaccatacctggaattttaaaagtgtttgtagagacaaggtcttgctatgttgcccaggatggtctcagacttctggcctcaggaaatcctcctgcctcagccctgtaaagtgctaggattacaggtatgagccgccatggctggccgagagcctggtcttttagagttagatggatttgaggatggagctcagtgctatccctcaccagctgtgttactgtgggcaaaattgcttatttttctaatcctcccttttctcaaccccaaaataagaagattgcaatagaataattccctctagggtggctgtgtcagttaatgagatcatgaatatggacatgcttagcactcagtatcttcctgcagcttgctaaaatagccacagtgtatgcaaaaatgtaaatatctttcggtataactgggctacaaatgatggtagaaaacataatcataccactccaaggtcatttcacatcttcatgtttaaaacagactattctgaaatagtcatttgattgagaaattaaattatctgatttcaacattcacatgtgctctctggtacattctctcctctcaagcactctctctccctttcctctgattttgtctcagaattatagttgtcaatgaaaagagtcaaaccctgtaaaacatttgaagagatttattctgagccaaatatgagtgaccaatggcccacaacacagccttcaggagatcccaaacacatgtgcctaaggtggtcaggctacaacttggttttatacattttagggacacaaaagacattaatcagtacaaaaaagatgtacactggttcagtctggaaaggtgggacaactggaaggcaagggcttccaggtcataagcagattcaaatactttctgactggcaattggttgaaaggattaagttattacctaaagacttagaatcaatggaaaggaacgtctgggctaaggggttgtgaagaccaagtttttatcatgcaggcaaagtctccaggtagctggctttagagagaatacattataaattattcttatcagacttagagagtctgttctctcagtaatttcaaaagggaggagggtataatgaggcatgtccgaccccacttcccatcatggcctgaactagtttttcaggttaacttcggaatttactttgctgagaggagaggtccattgcagtggttggagggcttagaattttatttttggtttacatagtctttgtgcaggggaacacttaacaaaaaatgaaggagcaagggaatatgtgtcaggtctgggtgctggtggctgggccctgctggcttctgtaggggcatttcaccccgttgggtctttggtttaggcttcagtcctgctgcatcccctgctggggtcatttggtccccctggcctttggatgcaagtgagcatctgggcccactgtcctcctacaaggcctctggtccagatgtcctcaccctgtgctcacctcaccccatccctggccaccctcagtctctggccctctgtatcagttatttattgctgctggaacaaatgcctgcaaacttagtggctcaaaataaaaacttttcttagaggtctggaggttagaagtccaaagcaggtctcatggggctaaaatcaaggtgctggagagactgtgctctttctgaaggctctaggggggaacctgtctccttgccttttcttgcttctggaggctcctacctgtcttttattatctgattttcttgcctccctcttttaaggacccttttgattatatcagacccacccggataatccaggataattgtcccaactcaggattctgtaagccaaaacaaaaatcccaggccccccaacagactgaacagagccaagagaaacctgaaaaatgaaattcacaatcatcatgggaagggaggttggacacacctcgttataccctctcccttttggagttcagcacaactgaccagcattaacactaaaatagagatcacaagactgacaaaacagactctgtggcaataagagatcaaattccatcctgactctagtgtagcatcacatgacagatatcagaccctgaaggaaatcaaagtattttaccccaaaatacatttctctgacactttgaaatggccctgcaaagctgtcttgtgtggggaaaattctacatctgtagagaacctccattaatgcagcccagtctttctgggatctaggagagattaactaagagtctgacacctttaaggtatgaaaagacacatttaccatctattcccactgaagcctgctacctggaggcttcatctacataataagaaccttggcttccacaactctccccacccgcttaccttaaccaaagcatttctttctactgatttcaaatagtttaactctttcaaacaattgccaatcagataatttttgaatccatctatgacctgtaagctcccccactctttgagatgtctcacctttccaggccaaatcaatatattccttacatgtattgatctatgtctttgcctgtaacttgtctccctaaactatataaaaccaaactgtaatctgacctccttgggcaccctttctcaggaccccctgaggctcttcctggagccatggtcactcatattggcttagaataaactcctttaaatattttacagagtttgggttttttgttcacaattattaatcacacatttgccaagtaaggtcacatactcacaggttctgggggttaggatgtggacatgtttggggggcaattgttctgctttccataccctcctatcattcccaacccctttctgggacaagcagcacacactggattcccccatgtcactgatgggccatgggaaagtggagatgctactttacgccgtcccgctgctgaaagcgccaaactgcctctcctcctccatgcagctgcctcatgggggtgggaggcaccaggtgaggccccttatctcagagattgaagtggaaagagtggcacaaacctatctgggtgtgtgttatatgacatcattcctggggtacataggaggcatgaataaagagcactggggaattttcagcctaagccttgatgtgacaatcctgcattccccaatccttcctgttcccactataatcaggaccaaaagagctgaatcctgcaggtagtgagctgggcttgattaggaaatgagaaggttctgggtgtgatgatctaagttccatataggtaggctcagatgcatgctgggcttgctagctgtatcggagttgatctttctgagaaggtgagttcaagctctgtttcactgggtggcagggaaagttttgttcaaggcagaaatggaaagtagagtctcacactttgacacatagggagagaccccagtatccaaaatcccagctgctgcagcatacccgtgggctctcttgagggcccaggaggagaaagaacctgaaagccaaggttggtacgctgttatggattcctggtttcctctgtgtgtgtggttgggggtaggggttggagtacctgttctcacatgcttctgtcctcaattttaaggtgtggcttctcaggagtctgtgttccctgagaacaggaggtgaagaatgaaaaggaaaatggctcggtcatttctagaggtgatatcacaggtgaactgcttacttctgatttccttcctaaaataccaatttacagggctaaagacattttgcatttgttccacaaggatgcagctccccattctggtgatgaggtgacagtcagagaggcaacagaggggacctaaataacccagaagctttctttagtgacccaagatttagtattcattcaacaaactgctcaaggtctgacccaagatttagtattcattcaacaaactgctcaacgactgacccaagatttaggattcattcaacaaactactcaaggactgactgaccaagaggagtcattagcacaggtcttctaggcatgaatttgtttgaaaacttttaagctgaagaataggagtccctggggatagtgagttcagtttgaagttggacagcttgcatgtgttggcagcgcagggagcaatggcttaacttgctctcaaatctatgggagagctggagcagggcacaggcagtcaggtggatgggatgaaggtggagggatgccaccatatttctgggtaacaaaagggcactcgtcctgacagacttaaaatccaacacatcaaactatgctaattaaaataatatagaaatgataatacgttgatgggtaaacagaagaaaatagaaggccagatacacattgtggtagaatgaacaatctcccccacccattgcaaaatgtccccatcctagtccctggaagctgtgaatgtgttaccttacatggtaaaagggactttgcaggtgtcattaagttgaggatcttcagatggggggtttctcctgggttgtctgggtgggcctgaaatgtaatcactgggtctctgtaagaaacaggcagggggatgctatgttgttggctttgaagacaggatagggctggccacgagccaaggaatgcaggtggtttctagaaaagttgaggaatcagattcttcctagagcctgcagcagggacacagcactgctaacccatattgtacttctgaactccacaactgtaagattataaatttgtgttgttttaagccatgaagttggtggtaatttgttatggcagcagtaagaaacattagcctctcactaatccacatatttagggcccaatgtttagaagaactgagtaaatgatggagatcacgtttccattagaggacaggctgatttaattgtggcatcaaataacaatgtccaaatataatagctagaattccattgaatcataaacgaatttaccaaaacatcttttaaaatgaagtctgtgaagacattttcatccctcaatcaggcagacctgagttaaattttacttctgtaatttttaatttttcaaattatataagaaatctatcaatgtatgatctttttaacaatgcagatgaataattttttaaagacctttttaatcattaaccctactcaaccactgtctttagttttttacacaatagatctttttttatatcaataaaatatcaattaaaaaagatctattgtgtatagatatgtaaagtaacatctccactttcccatggcccatcaatgacacaggggaatatgtctatattctgtaaatttttaagttttgtaatttattttggagatgtttccgtagcagcacgcatagatggcccttattctcaacatctgcaacgtgttctacagtgtgaattgtcctgtttttggacctttctcctgtttatagatctctatgtttgcagtatttcagtggtagacacaatgttgccatgaagtctctacatattcttaaactttaagaaagctatctagacttagaatttctgagtcaagggcatgcacctttaaccatgtgagatactgtcaagtcatgcttcaaaagtactatgctgactttgaagtccacaaatcagtgtgattgatggcttggttacatcccttaaaaacactggatagtatccaggttttaaatgttgtgactgtctcgccaaaacaagcaagacttgctgctaatataatgcgcatttaattgagaagagtttgtccacttattgatcatttgtatgctttcttcagtgaacttttcattcatatactttaggcatttgtctagtctgcagcttctatttttttttcttattgatctgtataaattctgaatgagttccttgttggttatacaacatactaatttaagttttttctgtgtcccttttattttttcacagagatttttctcctttataaggtcgattttattattttcttttatctggcacttgagtctttaagacatttttctattgtaagtctgaaaatcctcattttctaacattttaatagttttaataattatcttttatttcatctggaacatagtctcatagtcagggagggatcttgctctccccctactaagggatattcagttattgcctcagtattcattgaattgtttcccaacagacttgcaggtcatcttttttaggcagtaaacattcccatatttgcatctgtttctgggctctctttctttgatctcttcatctgtgctgatgacattcctaacccacttgaattactacaacttgactctgcaccctggcaagaacaagaccttcattaacttttcatgtaaaaaactagtctgtcacatttttcccttgtgtgaaaatcatgtatctgtttatcacagtttataaaataatcttaatggattttttaaatggagatactattgaatttatgtatatacttgggagacctgacatggttctagtattacttgcaaagaacttttgactgttcatattgagagactctgtcaaatctttagttttgactgatttataatactggtccaaaacccagtaggttcaagactcaagaagagctgatgctccagtttcagtctgaatcagcaaaaaaccgatgtcccatcccatgcagtcaggcaggacgaattcccttatcattctgcttgggtgggattctgacttagaggtatttggtcataatcccacagatggtagctctaccccactgactcagccaagcatgaacaccaaatgtatgtttccttagctgttactttatcataagtaattttgtcttcctaaactctacaagagtaaatcatacttttattgtctgcactttctattatagcttttggtcacatattctaatgtatccttatatcctgtgtgattccctagaatgcccaatttgaaagatatctaccagaggccacgtggaggcatgtatacatataaagtataaattgttatttcaggagttggtgagatttagagatgtggccgtggtcttctcaccagaagagtgggatcatctgactcctgaacagagaaacctgtataaagatgtgatgctggataactgtaaataccttgcgtctttgggtaaggaaggtcttgttagttcacaactgcccatgggagaattttctccttctgtgcaaatatctgcaacactccctgaaaatgccagttgaattttctaacttcatattcttcagtaaagcatcgtagctctgtgttaagagaagacattttcatcttgggatgatacaagcttcctattccccactgtcctcaaaatcatcacaccattctccaaaactatagtctgaggctgtcatatgcctaagaaacagctggggaatggtttaaaatgaagatggttttttatacaaaaacactgctttagaggttctgggaagattgagatgttaatgagattcctcatcactaaaaatgtgggtctaaattctgtaataaccacagcatggtcaagatcatttatttttcttaggaaactggacttataaggcacacgtgatgtcctctttgaagcaagggaaggagccctggatgatggagagagaggtgacaggtgatccctgcccaggtaacaagcagatggaagtcatcacagctcacacctcaactcagagtaacctggacactccccctccaacccccaccaggaggtgacaggagaagagctttcccctgggcttctgtccatgagtttccaaaggaatctttaccccacgtttatcactctccctgtaccctttttgttataattctagtcttaggacagtaaacggtgtgctgggaaaagtttggaatttaagttactacccaaatggataaaaggatgaatagctgaataggtcaaaaaacttgtcagtgattacaatgaatgaatgggttagctcggaaaagtgtcacagaaggttttttttgtttttttttttaagaaaattctggagagagactgattttctcttcaggttattagtttagagaatgacaaatcaggaaaacaaatttaccatctagttggaaagagacgactaccttcattaacagaaggtagaactcgccagaatgtaagatgatccagagatttcagagaaacttgtttctcgagtttcagtgctgacatcagggaaggcagctcattcataggctcctaaaagtcaggggataaaaagctgggttagatgatgatgaatttcggtctggagtatcattttatctaaagagtaaaataccaaattcatttaagctatgggcattttggaaagtggactggaatccacttattaaagattttataagaattgttcacaagaattccaaataaccctgtttattctttaaatacttaataacttggtccaaactcctctcctacccccaaaatacttcttttctctcccttaaactttcattttttatgcacctctgaacatttttctatgaagttatagtcactttcacatttactgcaagatgtttttcggatctctccactgccgccttgtggctttagaacacaaatctgtttactttgttttgtgacatatttgaataaaaccatgtatcctgtttagggctggcaatgtggtagtgggagggttggaaattggatacaaaaattgagtcaatcaattgtcactgttgctctagtcaagattccatcgttattttgtataaccttcatttataattcattatgtcattatgtgctagacagctggtctaa[133 bp omitted]cactccagcctgggcaacagagtgaaactctgtctaaaaaaataaaaatgcatatactaattgtaaaatatgcacgattttatatatggctgcactcttatttaaacagcatgctgcacaaatctcacttcttacctttctacttggctgtttctgaaatctttacttgttatatctacatgtctttttagtgccatataatattctttaacatgcatccatcacacagccagttttaaggaaaaaaaatcctaaatctctacaattccttctgacccaaatctcacatgctccctttagaatgtataacaattttctgggtcacagggcatattatagtttgacaaaacgtacccagattactttctggacatctgtgaattttacactccacccacattacttgtctttcctgcatctcaccactgcttgctaacatttgcattttagttggctccattttggtagttttgtctccttgttttaattctcatttccctaatagtaagatgaagctcacatgatattctcgtcatccactcactattcagcttttttgaattgcttcttcatgttctttgctcattttctaattttttttcttttctttgtggaattgaatatatttcatgttatatataaggtattttttggtttaaaatgtacggttactcctgtcaatctgtcatttgcctgttgactctggggcttctcttgatcagaaatccttcgttttttatcacatccatagcatgtttgacttacagcatttgcttattgtctttttgttgttgtttaagaagcccactgcatcctagaccacaaagacattctcctatcagcattacgggtttaaaattcacattttaatctgtctatatttgtatatggcataatggacaaccagccccattttctctgaacaatgagtcagtttttacaataccacccaccaaagcatccatcctgtcctcactgacttatgatgccatccttacacacaagccatcagtactatacatctatagaaatcatcttctgaaatttcttttattccattcgtgtatttgtctgttctggatgagtataatattcttttttattatagcagtgtggttttctagttatccatcatagtgggttcttttatttaaaattagtttcatattcttggagtgtattctttcactgataatcttgcttcaagtattttgaagctctgtgggtgcaaaaacacctagaattatgctctgttaattccttatccttatgaaataaacttctttatccctggaaatacttattactctaaaatgtattttgtctgatattaacatagctattctagctttcttttaactgttagcatggtatgtattttcctaacgtctactttctaaccaattgtgtctctaaagtgagtttcttgtagttagcaaataatttggttttactttctcatataagcttgataatctccaccttttcgttgaggtgcttataccactgggtctcaatggggagaagggaagatcttgccctctaagggcacctggcaatgtctgggtgatctttttggtggtagtaactgggtatgtaggcatgctgctggcatctagggtgtaacagccagggatgccaagatcctacatgcatgcgacagcccccataacaaagaattctctgatacaaaggtaaatagtgctcaggttgtgaaatcttgtgtttttatttttacatttactgtgattattgatatggttaggcttgagcctaaatcaaatagatttctatttgtcatatctgttcttcccccttttctcctttattctgctttattatccttaccctattttggattgattttttttttttaggattctattttatcacctttattggcttattagctgtaactctattttagtggttgtgttgggatttgagtttatggtatctgtctttaacttatcacaatctacctgcaagcgatagtatactccttcatgtagagtgtaagaattatactgtagctcttattttatatatatatatatatatatataaataccataatttatctccacctgcctttatggcgttgctgtcatacattttactttcacgttataagccccacaatacattatttgtgtttaatcagtcaatcttttaaagagatttaagtaatagtaataaacccatacatatttaccagttacatttcagttgcttttcattccttggtgtagggccaaattcccatctggcatcccttttcttctgccctgcaggacttcctttaaaattacttgtagcgcaactctgctagtaatgaattctttcattctctgtatttctggaaaggtcttttgtttgtcttcatttttgaaagccatatgctgggcatagaattctagttaatagttttttttttttttttagtaccttaaatattttgttccattatcttttatgcttgcagtgtttccagtgagaaatctgatgtcatctttgtctctgtgccatgtacataacgtctttttcccccctctggttgcttttacagttttctctttatcactggctttgaacaatttctttataatgtgtctgagtgtaattctcttcatgtttcttattgtgtgatttgcgcttcttggatctgtgagtttatagcttttactgtgtttgagaattttttgcccattatttcttcaaatatttttctcgtccctgcccccgacccccttccccctctatttcagagactctagttgcccagatgcccagtaccaacatgatgaagttggtaaatcttctacacatttttaataggactcacatttaatggatggtagtactttcttttaatcctgacttctcttttatatattctatttctccagttccttccctctaaaagaattctccaacctgctatttcatctttggctatgtaattttgctataaatgccaaccattaagttcatttaaacatatcttcagggtgggtgtggtgactcatacctgtaaccccaccactttgggaggctgaggcggtcaggccacttgaggtcagaagtttgagaccagcctggccaacatagtgaaacccgtctctactaaaaatacaaaaattagctggatgtgatggcatggccagctactcgagaggctgaggcaggagaatcacttgagcctgggaagcggggcttgaaatgagccaagatcatgccattgcactccagcctgggtgacagactctctcaaaaaaaaaaaaaaaaaaaaaaattaaaaaccatatcttcaaaccaactgttcccactttgtcccttttattaccactgattctgtcccatgttgaaatatttatgtttttgaaaatattactcatgtatatttataaatattccactatatctatacatttttctaagcacttcagtagcatctcagactagaatgaagaagataacagaaacctgtgctggttctccatcttatcagtggcagatttttttgtctgtattaacatatctactatattttgtatgtatatagaaatgctcaatctataattcgtatgtgtgtaggaatgctcaaatttctttctgcagttaaccagtttctagatgtttttattacaaaaaaagtgctagaactcatgacaccacagttttatataaaggtaagtttgatagtctagggttatcaagatactggaaaataatggtgtgttcatgcaatataagaacttcagtgcagtgcatgtatataccaaaaatataattgggaactctcatttctaagaatcgatactagaatatatttcaaattaacaaagatgtagatttaagattgttcttaatgttcttagcaacaacaaaaataagtacaactcaaatatccaaatagagcatcggcccaatcaataatgaccctgtcgcacagtaaaacattcaatatcaaattgataagacagatgtgtatttactcataagtatccccaattctgatgttcaaaggaaaatatttaaagtgtaatcactttcacaaattgctataccacacagaaatattttaaagggccttaatggaaacaaaactttaatccatgcttaggatttcacgtgattctttttaggttctttaagcttttctgttttggttattaaaatttcattcagccatttttacaatcacaagtataattatttcaagtttaaagaaatagaaaaaaattcaatggccactgttgatcacttaaatcattcttgtacgtggagaaacaattctctgcctctccacctccacaaactcctacttctcatcctacccctctaaagtctccagtcactgcactcttctttccctcgctttcctaattaacttgatgtatgttgcagtgtccagttctgattttttttctcatattgttttcctactagcatgtcaaccagcattggcaacgtttcgtgccctcaatgaatctgggaatgccttcagacaaagctttcaccatggagaataccgaacacatcgtacttttgtccagcattatgaatgtgatgactgtggcatggcttttgggcatgtgtcacaacttactggacatcagaaaatccataaggtaggggaaacccacgaatatggtgaaaatacaaggggctttaggcatcgctcatcatttacaatgctccagagaatatgtacactatataaacactttgaatgtaaccaatgtggtgaaacttttaacagaccttcaaaggttattcaacatcagagcatgcacagtggactgaagccatacaaatgtgatgtatgtcaaaaggcctttaggtttctctcatccctctctatacatcagagatttcatgttggcaacagagtaaacctgactcggcatcaaaaaactcatactcaaaggaagcccttttcctgtaacttttgtggaaaaacctttcaccgtttctcagaaaaaactcaacatctattaattcatactagaaagaaatattatacatgtaattattgcaaaaaggaattcaatccgtactccaaatttattctacatcaaagaactcatacaggagagaaaccccacaagtgtgatgtttgtgagaaatcctttaaaagcatctcaaatcttaataaacatcagaaaactcatactggagagaagcccttttcatgtaatgaatgtaaaaaaacctttgcccagcgcacggatcttgctcgccaccaacaaatccataccggaaagaagtcttttatttgcagtagttgtaaaaagacctttgtccgtctgtcagatctaacacaacataaaggaactcatacgggagagagaccttaccaatgtacgacttgtgaaaaagcctttaaatatcggtcaaactttactaaacatcagaaaactcattctatagggaggccctttgcatgtaatgaatgtggaaagacctatcgccttaactgggaacttaaccaacataaaaaaattcatactggagagaaaccctatgaatgtggtgaatgtggaaagcgttttaacaataattcaaatcttaataaacacaagaaaatccatacaggagagaaacactttgtatgtaatcaatgtggaaaagcttttagcttaaactcaaagctttctcgacatcagagaactcacaataaaaaggaaaactcctctaaaagcgtctcaaatcttaacaaacatcagaaaactcatgctggagagaagccctttccatgtaatgaatgtaagaaagcctttgcccagcgcatggatcttgctcgccaccaacaaatccatactggaaggaaaccttttatttgcagtagttgtaaaaaaacctttgtccgtctgtcagatctaacacaacataaaggaactcatacaggagagagaccttaccaatgtacaacttgtgaaaaagcctttaaatatcagtcaaactttactaaacatcagaaaacccattctatagggaggccctttacatgtaatgaatgtggaaagacctttcgccttaactggaaacttaatcaacataaaaaaattcatactggagagaaaccctatgaatgtggtgaatgtggaaaatgttttaacaataattcaaatcttagtaaacacaagaaaatccatacaggagagaaacactttgtatgtaatcaatgtggaaaagcttttagcttaaactcaaagctttctcgacatcagataactcacaataaaaagaaaccctaaaaaaagaggaaggtgaagaaggatatttagagatgacttaccctttgctaaactcgagatcaatgtagaaagaatcttagtcgaagcctaattcttcgtggattcatgctgtatggagtatcttggaaatataaatatgtaaatgttgaagaaatggagatgtgatcagaaatgtactttttttattgcactgacttgaatctttggccaaggcaggtggttcatgaggtcaagagttccagaccagcctggtcaacatagtgaaacccc[131 bp omitted]cgtgccattgcactccagcctgggtgacagggtgagactctgtctttagaaaaaaaaaaaaaaactgttaaatgtattcaactaaatttgaaattggataaggcatttcctgtggtaagcagtgataagctaagaggcagctagaaggctacagtgaacattcattttgctgtttgtccataatctactttcactggattaacaaatagaggcagctatctaaagatgcaaacttttataggctagatgatgcaaccctaatttaagcgtaagtaaggaaaacaaaagccatctcttctgggtgaattagaagttttggagaacttttgctagtagacagtgaaaagcaaaaagctgatcatggatctgaactaaagggtaaagagttaggaggggtaacatgagaaatccaaaggtcttgggtctgtggtcaagatggtttctgctgtcttgtctaaatggtcgggcgcagtggctcacgcctgtaatcccagcactttgggagactgaggtgggtggatcacttgaggtcaagagtttgagaccagcctggccaacatggtgaaaccctgtctgtcccattaagaaatagctcatttgaaataagtgaaagaaaattgaatgaagagactctttacaaaagtgtggaaagggttgtgggaaaccaacaagggatttaccatccctagccctgaagggaaagcaggagcgtggtgcctttgtagtaaaaacacaaaaattagcatggtatggtggcgtgcgcctttaatcccagctactagggaggctgaggcatgagaatcacttgaacccaggaggcagaggttgcagtgagcagagatcatgccactgcactccagcctgggtgacagagcgagactgtctcaaagccaaaaaataagtggatataactaagacacccagcctccctgaatagtttgcaccattcttatatgtttctagagaatcaagaagaaatggaaaaattgcaacaattctaggctttagattcagaatatggagaacctattactgggaatattatgttatttgaaattgatttcttgttgtatgtcttaaatgctaagctttctagtatatgctaacactagcatgtaatactgaatacatttgagccttgtatagaagtcgaattactttcccaaatttgttctcataaacgtcggtggcaacttgcctgtgtttagccaagtgggatgggcatagttaggattggcctcaatccatagacactattcagtttcttcatgctctcacctttctttgctttctcagatatgacaggagctgccacagagctcaagtgttgtataatccccaggtgtgcttcctttccatctgcctcattacttgtgtgttgaggcatcagtacgtttatatctctaaggaaaggtgtatgtgtatatatagctcactttttacaaataacagacacatcagttttatagatctcaagttaaatataagccaaaaatgcaactgaaataatttagctcagtacaaagaaaatattgttatgaatattataaaaatgggagtggctattgggataaagacaaaaattatacatgggacctgtcatccctaattttggtccttaatatcctgggttaaagttaaacaggagccatttcatatgtttcaaatacacgaagactttccaacacagctcctatcaggtcaaactgctaactctaaagtctagagtgagaaaagtttcctaggacacaccagaacaacttgttctgaaaagcctcatatcccaaattcaccatcactaaactcaaaaatttttcattgacatctaacactttcttctttgtatctctgccatatttcctaggcgctgtcactaattcctaaacccaatgtctccagttttgtaaaaaagataaaagaatagccatcatgtaaatgttaggctattcataacattctcattggaaagtttcagcagaaagttttatattttcattggggttttaatattaaaatcacataacagttctattgtttaagcaaaaataacagatggagagagaagttaaatacttcaatttaggctcaaaatatcatctgcacaccaatgtaaatgatgcatcttttgcatttaataattccttatattttcattctcacatatttgaggagatataaatctaacagagcgtttgtggattgaatggaatccctccctaaaggtatgttgaggttttaactgccggtgctcattaatgtgaccctatttaaaactaggatcattttgaagatgtaatcaagatcaaatcatactagattagggtgggtcctaagttcaatcactgacttcataagaggggacacaagacaactggctgttgaataaatgctttaacccttttaaagattaaattatctctgaagataacttccatagaatgcaaaattggagtcagcacagaatatgatccatgtacctcatataaacaatactagccagtgatttgatgcagagacctatctcttatcccccaccttttgacctaaaacatatctggcctggataacttttaaattatcatggggtataagagtattttctccattgtcagggaaccaatatgaggattctgccactaagtctgtctccactgtgcattctgggactgaggaaataaccatgggatgcacgtgtgtttccactggcagaagcaaaccctctgggagttggattcaggcccagactcatctatctcccgaccttcataagtctccactctgatcataggccactgtagtgcttgggaacagcaagaattcatataatcaaagccaatatccaaatccccatggaggtctgggtatgtccttctccctcatgcatggccacggtggtaaatgaccacagatacccctgggaaggtctggaggaagatctgcatgatgcttctatggctacattgcaggaaccttcttaaaaggtcttcctgaagccacttcaggtctaggaattggcttaagtctcaaagttgagtaaggtgctatgaattcccaatataatcccataagtcatacttctgcctaggagacccagaaattgttcacctatatgtcaagctgctccttcgaagaaagcccattttcattatacggtctccatgacgcactagctgtactgccaggcccaaacctgattaccagtctttcctaaggcatgctgtaacagtgtcagctttgtttccaaaggtgaggtgctgctgcatggcctcttccactccccagaatctcattttcattttgaggatctgtttcctggggccatttctggtaccacttacagaatcagtcccatcaagaaatagctcatttgaaaggagtgaaagaaaattgaatgaagagactctttacaaaagtgtgggaagggttgtgggaaaccaacaagggatttaccatccttagccctgaagggaaagcaggagggtggtgcctttgaaatctgtcactttggcttagctgattctatgttccctagaactcccttccctgtatgtttccagtgagggtgggtcacagacgacattttggcgtgagatctggagggtgctcgcagaggagcaatcatcttgcttttatgcttagcaaggcttctgcacccgacacatttcttacctgctggttcttgttggcatggctcagtagatgagcctgtggctgctctcctttccccaggatctcctccagctctttcagctcctgggctaggtgtgtgcttagcaacaccacaaatggcaccaacctctgtaggacacccacatcgtttaggtagaagacagtaaaaactgccacagctttgtctgtgggttccagcttgtctttattctcttagtgttcactttcactacttgcttggcctgcagaattaaagtaccagcatcagccatgaggacagtcacataacagccttcccgtaatagcctggagtcaaatcttgataacaaatttgtcatctacagaacatacatatggctctgctgctctgattgaactctaagtgatgcaggaaggaaatgacttttgggatctgggaatagctctagctgcggaagagggccacaaataaggtctcaaccagacacctgatggcaagagacctcagctgatgcagttcatagaggtctgccccaagcatgaggagtggggtagacagtggttctggagggacagagtatccaggagcatcaggcttctgaagaataacacttggtctagatacgatggaacaatgtgttttaggatatgcaaagaaagttagctggagattttctaaccagtcagactgatcttcaaatatacataaagtccataggcaaaccgttaacatataataattcagagactgatatgtccatcttaaagaataagctatcttttaaattagactccaggtgaacaggaagagaagagggaagaagagattaccaactaatttcattattgactgacagtaagaaactaatatactatcttcccccttattccctgcaaataacagggatattaaggcattatataaagatatcagtatattagtaactgacagaacaaaaatacaaatgctccacaacactgtagtgaaagacaaatgggaagataaaataatctggcaaaactgaaactaaatgtgtcatatcaataacaccaatttataaaactctctcattctctcatataatcttattccccatttcattgaaaaatagaaacaattctaaaataaattcacaaacttctgtcacatcaacccatatgtgtgagccagcatggcatgaccattgcctattttcttaaaaaggctacctttcccccttacacatagattccgacctatctcacctatgcagaacattattccaagatttccccgtctatggaacatttcccttaagtgtataaacatgcatttatctctatctctagaaagaagcctcctttgactacactttactctcgagctacaatgccatttctcttgcctttagtacgacttcttgaaagggttgtttgtattaactgttttcagcgcgtctcctctcacctttcttgaaaccactgcattcttatggtggttgcctctggtagctagcctgtgagatggctccagaggtctctacctcctggtactcaggctcctgtgtgatacccttccgcaacatatcaaggttggtctgtgtgaccaattaagtacagtgaaagtgatagttttccaaagctaggttataagggaaactgtggctttggatcactcattctgaggaatcaatgccggctgccacgttgtgaggaactcaagaaaccctatggagaggtccatgtgatgaagaactgaggtctcctgctaacagctgtgggagagagccatggtagaagtggatctttcagccccgtcaagtctttacatgactgcatccctggtcaacatcttgacagcaacctcaaagaccttgagcctgaaccacctagccaagttactctacaattcctaaaccacaaaaacaatgagatagtaaatgtttactgttttaagttgctaattttggggataatttgttacacaacaataaataatacattaacctgttatggggttgaattgtctccccaaaatgtgtgttgaattcctatacccaagtacctcagaatgtgaccttatttggaaataggattgttgcagatgtaattatttaagatgcagtcatactggaggagggcaggcccttaatccaatgactggtatccttataacaaggggaaatctggacacaaacatgcacacttagaatgccatgtgaagggccgggcgcggtggctcacgcctgtaatcccagcactttgggaggccgaggcgggcggatcacgaggtcaggagatcgagaccatcccggctaaaacggtgaaaccccgtc[133 bp omitted]cactccagcctgggcgacagagcgagactccgtctcaaaaaaaaaaaaaaaaaaaaaaaaaaaagaatgccatgtgaagttatgctgccacaagctacagaattatcagaagctagggaagaggcctggaacagatccttcagaagagagtatagccctgccaacaccccaacctgacttctggtctccagaactatgagatgtatctgttgttctagaacatccagtttgaggtactgtgttacggcagccctaggagatgaatacaccctctatatcatgtctttgttctttggctacttttaagataatctttattaaactagttttgatttctttatgtcttgaaatttggtgtcttattgtgctcttcatttttatcctgcttggggttcattaaacttcttggacttgtgaatttacattttccgtaagatttgaaaaaattgttccaacattaagagataaatttagacaaatttggcacaaaaattaggtatttttgtttttctttactctattagtttcaaagtgaaaggtaacttaatttctttcacaatagcaaccaaatctttgaagtgactattaatacatttcacaggaaaagagcaagatcagtatacacatacacatacatttaaacatatgtatatacttacatatattaacacatgtatatgtgtgtatacatacatttatctgtcctgaaggacataaaaactgaataaatagataaatcatgttcatattgggttctctgaagggccccaaataaatagcacaatttccccccatctaaacgataaaaaattaagtagcagacagggggcaggatgaaacttttattactgatcaaattgagttggaggatgcaacttagtgtgaccattcagctaatgggccaattagctgaatgacagaattagaccaatttaccaatcacaggcaatatctgtgacaagaaattatacttgcaggtcagcccacaatgaagagggagttcagctgagcaaacccagttacccatcactatcttaccaactagataagcccacttcctcatgcctggggcagaatgcataatgtggcagagaagctaggaatgggtatagggaaaatcccactcatggaaatcagaacttgaaaggtaaacatttcccaataaccccataaaagtggcaatcctacctcatcatatatatccatataatgtaatcctaatcagcatcccaggcgccttttgttctcagaatttgatcagtgacttctaaacaatacctctaatgaacatgttgattaggaaatccaagagatttttgaaaacatactaattgacataaaccactggtagatggggttgagtggatattacagaatactaaaaccagagaaataaacactttttggattcaaccatcatccaaattctctttgttgttcaagaatgcttattttcccatgtttttcctactgcaattgccgtcttcttgacttagctgaaagcttcaggatcatgaactagttatcctgtgcctatcttccattagaaaggtcttaggaagggctttcactggctcagctttacaaaatgctcacctggggtataattaccatgggtgcatagagtacaatggttagttctcctgagttgtcacctttgcagataaaggtatacagtccactactagaagactatggagttagcagacaacaaaaaatctgccaaatctgaaaatacaccataaattgagaaactgtaacttactcaactatcaaacaatggtattgatttgaaatgaaggtcagatcctcacacctcgtaacatacactatcaagtaacactgtggggaggaaccaagtaacaatttaacttaaacaatgtttgtttcattattttaaaagggaggcacatttggcataacctttgaattgctgttgaatattttcatagttcacaatgaataatacatttattaaacaaattatttctttcctacatgatttctctgatgttacattgagggttgacttatggcagaaaaattttccatattcattacatttataagattttactcctctatacatactcacagtttagcattgtgtaagttatttgatttgttgctttgttggaatttattactttgttggaacttattccttgtgggatttctgatgtaaaagaaagtttgatttgtggcgaaatgttttctcacatttgttacattcataaggtttctctcctgtgtgtattttctgatgttcagtgagagtccacaggcgacggtaggttttcccacattgattacattcatatggtttctctcctgtgtgaattcttctatggactctgaaggctgacttatggcagaaggatttcccacattcattacattcatatggtttctccccagtgtgagttcgctgatgttcaacaaaggagaacttctgacagaaggttttcccacattcattacactcatagggtctctgtcctgtgtgtgttctctgatggtgagtcagggctgacttcctgcagtaggttctcccacattcattgcattcatatggtctctcccatatagttctctgatgtacaatgaggtgtgagtttttgctgacggcatgcccatgttcactacactcataaagattctcctttgtgttcattctcttacactgactgcagtttgacttcacaatggagattctaccacatttattaaacacaccatgtttctctcctgtgtgtgttctctgatgtatagtgagtgttgacttatggcagaaaaatttcccacattcattacattcataagacttctttcctctatgagttatctgatgtgcaatgagggctgatttcgtacataaaaattttccacattgactgcattcatagggcttctctcctgtatgacttcttcgatgcacattgagggcagattgacaaaagaaggttttctcacattcactacattcatagggtttttcccctgtgtgaattctctgatgcgcagtaagggctgactgacagaagaaggttttcccacattccttacattcatttggcttctctcctctgtgagttctttgatgtacaacaagatacgatttcttgctgaaggcatttccacattccttgcattcgtaaggcttctcccctgtgtgtgacctgaaatgttcagccagggctgacttccgaaaaaaggtctttccacattcattacactcataggatttctcccctccatgaattttctggtgtacaataagggcagatttgtcaatgaaggttttcctgcattcactgcattcatagggtctctctccagtatgaattcttcggtgtcgagtgaggcttgtcttcacacgaaaagttttcctacaatcactacaaacatacggtttctcccctgtatgaattctctgatgtacaatgagggtagatctcttagaaaaggttttcctacattcattacattcatttggtttcctttcagtctgtctccccttttgtgtaatgagaattgccctcttgaagaaggttttcccacatttattatagtcaaacggttgtttcaaaatctgaatgttctggtgcagaataagattttcgttttgattgctggctttcctcattggattgtatctgtattttttcattcccaaatgacttttctcatgcttcccaaatccactgtatccatcaggaatctttctgttttctttgcttttctttgcaacaattacttctgaattagttttcaaactgtttcctcctggattacatttatagggcatttttcttgagggaacactattcatgcccagattaagtgttttcccaaatacattctctctttctgtaatcagtgttttgttgctgaagaatacagtttgtgtcaaatgtttatcttggatttccttgttcttctctaaggcatcatcaatgtctagaaaaaggaacacaattaacggtaattggtgagcctttatatgtttgctatgaaatgagaattccttagaaatgcattgttttaggggttagacttcaggccaagccttccaagattaaacaaatttcaagtgcaaatatctcttacttggttgatttgaagaaatacagaaacaaaaaatacaaaaaagcaaatccatccataccagccactatttaacagggggaaaggaagaggaaactagcaaagaatacaagtacctttgacactttacaaatactactaaacattgagtggaaaaagtaaatagtcacaaggaatagtacacaaagtatgctggaagtgtggctgatggagtgttgaataaaacagacaagagtcaagtaagcacttagagaaagatagtcatacagtgagaccaggtacaacagatatcagaaagatggtcagttattatcaaaacacacaagaaggaagaggtaaatctgaaatttttgcagtgacatggaactctcgaatttgtacagtgcaaagggaagtaagattgtgggctgagtagagctgggactagaggaaggcaagcaggatacccagggcacctgtgcaatcctgagagttgagtgtcttcctaaattttgcatgccaggcaccttgtttgcctcaccctactccggatcctggtgaagcgtagaatggaaagggaaaccgtgttatttctgttaagtgacgtagagaaaaatggaagacaattaaaaagatcatgacagatctctgaatgtctgaaatataaaccaagcctatgacaatggtgggtggggcaagggaggcaacaaagaatgctacagaaataaagtttaaggtgtgataaaagaagaacttgaattttggggataggtaacttaatggcaaacatctttataaatttcaattatttatttggggagaatgtttcagatgtccatagcatgacagttaatcaacctcaatcacttctaaaggtctgggccaacaaaaagaaattcatgaaaaacattacgatgccaactattaccaccgaccaccatggaactctcatttccattggttccacctgctcagttatcatttacttacctgggtagttctgatttgagaattcctccactatccatggctcttctccttgctccaatttgaaaatcacatctggtttgctaacatgataccctgttaatgggaaattacagaacttggaccaagatctttggacatcagagactctgaagaatgaagaaagtacagcttcagaagctgtgcaatgaagatgcccagcaatagctcagtaaagctagaacattttggtgaagggtaggggaagggcagtgaatacatacacaaacttctactgtctaaaagggtttaatcttcttgctcccctgatgctcagggctaaataaattctagaaatcaacatgtttttgtaacacagaagaaatgtatgctcttgggagttgtacagggaaatagtccttacccacagagaccaagttgctgtagttctccagcatcacatccctgtacaggagcctctgagcagggtccagttgctgccattcctcttgggtgaagttcacagtcaggtcctggaatgaaactggtatctgaaagaaaatgtttaatcttgggtgaccaaaattgagtgatatcaaatgtatggtaacataaactataagaagaccactgccatggctaatggaaagctatagagagatgtaattgtgggagggcagaaaattaaaaatctgtcactgtgttcattttttaaaatgaattttaaaaatgtgctgagcttataccatgtcctggagctattccaattgcctggattactaatcacataaaatactaatcttactctttaggagcatacattctgacagggtgacaaaaatagaaatgtacatctttaaagagcaatgctggacatatacacaagatgaagggtgatcacaaaagaagaaagcttgctccatttttgttaccccttccttgagagcataataattttagtcctgaaatataaacagtatgttttataggactgtagccattaagaatatacacagacacaaaacacatatggggagttcgagaactacaatctctccacaggaaaggttagtgaggagcgggacagaggtcagagaatagaggaactcttttctctaattagtagtcttgaaatttagatagtacggcacatcagtaaaacattcttgcatatacgctaacgtacatttacttaggaattgtagtatatttccaagtgagttccagctatacactaatatcaataaagcttaattattttttcattcttttggctgaaatacaagaatagaagtccagtgaattgctggggtgctccctatcctccactttggagatcactgttataaataatggaaatccataaagagttatttgtaagcaaggactggagatttgtgaccaaatgtgtattttgaaacaatgctctagagcataagagttggcaaacttcagtccgtgggcaaaatctaggccactgggagccaaacgtggtcacgctcatttgttacacacagtctatgactgctttcatgtcacaacagctgtgccaaggaaatccaacagagaccacagggccagcaaagccaaaaattttgaccttgtcctctaaagaaaacatttgctgtcccctactctagaaaaatggaaactggcttaaaggtcaaattagaagggaagaaaactaagacactactacaggacatgagcacaggtagttcctgggaaatgggaaggagagaatcagtcctacataacgggaggcaaggagagttgaccactacttgatgtgcagtagatgtaatgtgcatattatttcacatgatcagctgggctgacgctagtagtatatgtggagattaggaaaacaaaacaaaaaagagaatcgagcataggaaatgaaggcactgatctttaccatgctgtgcttgaagtgtctgttgagtaaagaagtacagatatctagctggcagtttgatatatggttctggagctcacaggagagataccacagtgatcagaagcaatatttgaaagcataaataatgaggaaggtctccatgaactgatatgaagtgaaaaaagcaaagtattaaagaatatctataatatattaccttttatgtaagaaaggagatgtaagaaaacacacatggccaggtgtggtggcgcacacctataatcccagcactctgagaggttgaggtaggctgatcgctggagctcagaagctcaagatcagtctgggcaacacggcaaaaccccatctctacaaaaaaataaaaaaaaattagccaggcatggtggcatgtgctactcgggtggctgaggcaagaggatcacttgagtctgggagtcagaggttgcagtgagctcagattgtgccactgtactccagcagcctgggtgacagtgcaagacctcatctcaaaaaaacaaaaaaacccacatgtaaccactacatgtgaaaaaaaattatggaaaggatacaccagaaactcatgaaactggttacattcaggggagaggtggagacagacggaaagaatggacggatgggaacagagtagaagagatgagaaggagtgacacttctctaaaatatctttctatacggttttgattcttagaactatggtaggccaggcgtggtgcctcatgcctgtaatcacagcacttcgggaggctgaggtgggaggatcgcttgaactcaggagttcaagaccagcctaggcaacatagtgagaccccatctctcaaaaaaatttttttttttttgccaggagtggtggcacatgcctgtagtcccagctacttggaaggctaaggcaggaggattgcttgagctgaggaggtcaagactttagtgagctatgattgcaccactgcactccagcctgggtaacagagcaaaacccagtttcaaaaattaagtaagttaaataagcttaagtaagtaaaaaggaaagaaagaaaagaaagaggaaaggaaaagaaaggagaaatgaagggagggaggaaagacaaggaaaagaaaacaaaggaaaaacaagggaaagggaaggggaaggggaaaggaaataaagaaaaggctaggatgaaccctgcaaaataactagccagcaaagtgtcaaggttgtaagtgacaaagaaggaccatcgtgggttgcaagaggctaaggagacaggacatttaacacaacctgggttcctaggttggatccttgaactgaaaaaggatattatggaaaataataagcagaatttgaatacgatagataataatactgtattcatgtgaatttcctggttctgatcactataatatagttttgaaagatcaggggaagcgaggtgaaggaaacacaggtattttgtgtatgatttttctcattcttcgtatttaaaaataaagcagtaaaaaataggcatgctgcctccacctctgcagacacctgggctttggcctgctgtatgtctcacctcacccacatgaccatcctaggtcacccgtctttcttttctttgatctgctatacatctttctactgacaaattttattaggtaatttaatgaggcctttcccgctatcaccacttaactgtctcttaaaccagaagtagttacattatccattttatttcttccatgaattacttcctctgaaggacctataagcttcctgaagataaagagtatctcataattataggcacaacaatagacatataaggtcttaatgactagaaagaatgactggcaaaaatattagaaacaaaacgccagggagaaagagtgccagggaagagccctcactagaaagttctgtacttgctcaggcagacccagtgcacttcatagcagaaagtccaaagtaagaacagtgaaatgtgttcactttgtgagaaactgaaaggtgcttatgacaaaagaaaaagaaactcgattctcccggtgactcaggtccattctgcaagcaatactgtaagtagaatgatgatccattcagagcagaggagagttcaccatttcacacaaaacaagattacccaaaaaaagaaatgatgagtactactatgagcagggatatggctactgaggacatgtgcctacacctttaaaggctaatagtcttacttgtgaggtagacagataatgaccagaccctacatgtaatgcaaagaagagggccagcattgctctgtaaacacatagtctgtggacaaagaatatgaggacaggaatgggtcctgtgacgagatggctcctggctatgttcacaatgtaggcagaaaaggggtagaaagtcaaggagcaaacagtagaaacacggttaaaagcaagagtgtaaaatttggggcatgttcaggagactaaatgcagaccaccatcgttcttcagaggggctcaatgtgggtggtcccttccatcaggggcatgtggcacatctgcggagacatttttgcctgtcagggttctgtgggatgctgttggcatttggtggaaggagagggaaggaaggatggtagagacactgcaacatgcaggaccttctcctacaggaaagaaatgtcccaagtcctgtataactttctaatcttaaatattcatataaacgaaaaatcctgtttataatgatctgagcctagaaccttattccatttggcacttgaacacatagtatttttatatattttttatgtatattaaattttcttcaatgtaatagtggatacatcaagcacaatttgtatttgatttgaactggaacttcagggattttcactcttgaaaaatatcacaaatggcaatgctatgtacagtatttgaatcatgacacatcagtcccatatcagtgagaacttgtaattatcacgttcatagaaatttaacctaaaagtaatctgtataaacaccagactcctcttcttttactatagttttatctgggcaagtctatattaagatacatatcatttttaattacttttttatttttcctctatattcgagttctattgatttttttaaaaattacacaagtaagttgtattatctatgatctccaaaataggataaagggaggatggcttttagttgggatttctagaaaacagatcctaaggcaaggacttggtctgcatcattccatctgggaactccaagccggggtagtgagggtgagggaagtaaggaagggaggaaagaaaggatgtaaacaatgagatatgagaggcattagcatgctgcccaccaactcactacaagccccaaagaggggcaagtttcctcagcaggagcatggggtcagcacgtgggtcagcacatgggacatctctgggaggaccaccaggagaaactaaccttgaaatagtgcacagaatagagaaaggatggggaattcatctgcccacctccttctcattttccatttcccttcattcaaggttcacccacggtgagttaacttgcgcacacttccaggttgcatcatctggctccaccatctggcccctcaggaagctggtaccacacctcatggtgtgtggtttcatccaagtctaaaacaggaggcagcctggtgtgggtgggtggcattaactaagagagataaaggggatggcagaatatggaaggtttgcatcccaatatagctcctaagaaagtatgttctgtaaaaagatatgggtctggcagagttgagaaccacctcagcacagtttgaattgcttgtgtaatatctttctctttcactagcacatgagctccatgaggacagagacagtatctccttcattcaagctgaatgtagaccatctagcatagcgtatcacacacaattgtttgatcaatatacagttgttgaatgaaaggtccagagtggtaggaactgagaagaggcaggaaacggtcatgacatacatagccttacaggtcataccaaggatgctgaacttgtattctgcaagtggcgtggaacctcttaagtcatttctgtattaagacatgatcacgttggcattttggaggaattggtcagtgtgaagaacagccttgaggtgggaagaggaaggggccaagcagactgctgagaaagctactaatattatgacaacccacgagaaactgaggcaggagaggaggagatggaagtgaaaggacaaattcaagaaatgtttatgtgacaacattagcaagctcgacaaacaggtatggtaggacgtgaggaaaaggagaattaagatggacttcaggccgggcgcgatggctcacgcctgtaatcccagcacttagtgaggccgaggcaggaggatcacgaggtcaggagattgagaccatcctggctaacatggcgaaaccccgtctctactaaaaaatacaaaaaattagccaggcgtggtggcgggtgcctgtagtcccagctactcgggaggctgaggcaggagaatggtgtgaacctgggaggctgaggcaggagaatggtgtgaacccgggaggcagagtttgcagtgagctgagatcgtgccactgcactccagcctgggtgatagagtgagagcccatttcaaaaaaaaaaaaaaaaaaagatggccttcattttctggcttgtctcgctggtcagatggaagcagcactgatagggaaaaaagaagcagcagcacattgagcaagttgtaagtattatttccatgttggatatgaggactccatgtgccttctggacatccttacagagatgttcagcaagaatctcaagctgaggtcctcagaggcagaaatacctcagagcataaagactcacaagttaaaaccacaaagggcatgaaaaaaaatcagaaagaataatgggctaacaatggcatagcaatgttcatgaaacaaaagattgtataaaagatataaagaagacatgattacaagctgggtgtggcagctcacagctgtaatcagtgcactttgggaggccaaggtgggaggatcacttgaacccaggagttcgagaccagcctgggcaacatagtgagacctcatctcaattaaaaaaaaaaaaaaaagacatgattacagagctacaaagagaatcatgtgagtgataccacagacattatcagaggtgcctattagggagggggcagtcatactgtcaaatgcaacaaagagtttggtaaagtatgaactgaaagatactcattgggtttgaaaatatttaggttactgctaaatttttccagaacagatccatcagagtggtgggggcagacaccagactgtatcaagtgggttgaaatgagacaggcacatgaagaagttttacctacagaatataatattgaattgttccctctagaacttgttttataagtatagctgaaataaagttatggggcattatttgaggaacactattttatttgttataggttttatccatttattctaggtcttatcactggatcatagacatcacagagaaccatcagaatgctgcctgttcggatgacactggattggttccctgtaattactgtgctctgcctgggtatagaagtcacaggaaacccataccatttctttctcagctgtttttggcagaactgtctctacttcacttactcaaagatcatccaagaaaatttttagatataaatgatgggaaaaccacacaaaaatccagtgtaagggctatctcatattgtctgggcctttctggaaccatttgagtaactctataggaatatatgatttctgtatatctatgtccacttttccagtattgatcgaatactcttctctgatgctgaattttatacatttcgtttcatctgcaaactactctaaacctcttgaaattcactgtataatgtgagaagtaaatccctgagcaacttacctgaaattttttcattttcatgttctcttgagaaagggccaagagtgttgaaagcagagctgggtaaggaagaatggcgaatggaatcatgagcgatttggctcacacagcagctctacaattacctacaaagccacacacccatttaaaaacatggccctttgaccagtctggttcaggaagcaacatgttgaggaaacgttcacttgtccatttatagttctagaatggtctcatagagcttttcttactgagtgagtgtcaacaaatgttttctactgaattactgtcaatctatgcctcctttgaaaaaaattgaaaacgtctgagtccaattaataggagactaggtcaacgaaagttagtatatacaaagcctggaacactattttggcattaaaatggactctaggattaaaagatttcttggaataggaaaatgatattatgtcacttacctgttttcctactaatgtgtttagccacttgagatgacagaatccagagagaatgaatgaaagtgctttaaggtgtttgtctttttgacagtttggtttcccttagctgcagtttcacaagaggaccttttactaagaaacttcttgtggtaggtaacgtaaatgtggtagatgacaaaagccctgacctggtactcaaaggaccagaattcagttattggatctgtcactagcaaactgcattactgaaaaaaatatttactaagtcgtaattttaatataagataaattggtttttagtctttcctttacccctatcgtgtagctctgtaaggggtaaactcagtaaatcccaggtgaggtgatgaacatggttggtgcagctctgaataaacagagggtggagatggtagggaatgacatgtatgtgtttaggaagtgatgaagacatcatttccttatttataaccagtactccttccctccaacccaggactctcgcagatacctccagtgaagtgtcttttcctgtcaaatcttgaccctgcccattccagctcacatccttcttccgaaagttgaactgaactttgctgagctataataatcaatggctgcaagactaagtgcatcagcagaagttctggaaagaggttctagctacttggatgcgtaaacctttcaccttcaccaagcgccttcttcgggcaaatcagggccctagagagagctcgcccgtggcctgcaggtcaggagcccaatcctgccctggctgcctcgcctcccgaccacaggaaaccctccctccaaagacagggagagcgcgcgtccaccctccgcagacccgaggcccgctccgcccggccccaccgttccctccgacgcccgagtgctcagagctcgccgccagcccttcctataggttgtgggtgcacccgcttcgcctccagttcgcaccaggtccaagtctcggcgggaccagggattcacgggctgcaggaccctcacccggaagagcctggcgaaccggaagggcgtccaggtaaaaaacaggaacagcacatgcgcagaaaggcccccgggccgcctttcccggggctctcccgggccccccgccggctttccggaccacagtccccagaaggcgtcgcggccaccgccctaccctgagggatctttgaggagcttctgctttaactacagagtttaggtgactgctgtgaatcatcaatacgaaaagtaaagtttcatatccgtttcaccgaagtctatagatgagaaaggaaaattctgcgaaatgaaaatgactgctaaagatattccagcagaatataatactaacgacctgcagaaaatttctcccaaacaggatacaaaatcattgctggctttcaatacgtgaaggttgaaaataaatcagaatatctctgaagaaaatgaactattagccgtaaccccaattcccagagatatccgagtttaacattaggtgcacattcttctgacagctttacaaagaggaactcatataggtctagtaatttgttattttttaaattagcaatatagttaatatactttaataccacgaattatctcatatacattgtgagtaatatagaaaatagttttacatccacaaggaaaatacatacaatcatgcatggtttaacgatggggatacactctgagaaatgtgtctttaggcaatctcgtctttgtgtgaacatcatggagggttcttacacaaatctagacaatatagtctactacacacctaggctgtatggtatagcctatttctcctaggctacaggcctgtgtggcatgtcactgtcctgaataccatatgcaatggtaacacaatggtatttgtgtatgtaaacatatctaaacatagggaaggtgcagtaaacgtacagtattgtaatcttatgagaccacagttgtatatgcagtacatcgttgactggaacattcttatattatgcatgactgtatatgaattgtatacatattgaataaatagaactttataaaactttactcattggaaggcatgaaagtttctgacaaagttataatgtattattattcaattccagaaaagaacaattagcgactggtggtagctagtcttcaaagatggcccccaatgaactaaacttcccagtattccaggcttgtatatttccctcccacgttgactttgactgactctgtgactctctttaaccaaaagaatgcgtcagaagtcacactgtgccagttccagaaataagccatacaaagtcctggcagcttcagctttgccctttgaagagtccttagacgctgtgtaagacatgcagttaacctgttagaccaagtggagaaaccaggagaagtaggaagtgagaggccctgagaccacatggaaaaagagaggcccatctttcctagcaatgcagctatcccagccttccagtcatccttgcctagagacatcagacatatgagtgaacattctaggccagtgaagttcctggatgacttcagctccagatgaaatcatatagctgatgccagtaaacatacagactacaagaaataatgaattttattattttaagcctctaagttttgggtggtttgttacacagcaatagctagctaagcaccaacaaaagatgatttccaagaatataatatgaaaagctgccatttcaaatcattgagaaaggcttattgttaaatagattattgaaaaagtgatgtgggacaactcactaaccatttggagtaaaaaactaagattcccatctcacacattataatcaatatatttcacattgacatataatttgaaatgttaaaagcaaactcacagactaagtgatttttgcattacttgctagggaagctcttttactgaaatttattaaagcaaagtttcctagtcatcaagaaaattgaatatatttctattcattcaagtttagatagtctcaaatgttttgctacttttgtaattgggaacatttttctatcttattttcattgccatgtaaaagtgacactgtagagaaaagtattgatcaatttggctatgaaaaattgaaaaaatcttgcttcagaaaaaaatagatttaaaaagaaataaatggagaaaataaagtggtttcatatatatgagaaggattggaaatagactcaatttattaacagctcttagaaatcagtaaagatgaggattcaaatttgtttaaaaaatgaaaaaagaacatgaataagacaattaatatagaagaattgtaaaagagccataactatacatatgaggtaatggccaataatactctagagcaaagaaatgcaaaaagtttttgattacgtacttttttggcagactaatttggcaaagattaaacggaataataaagtattggcatgaatttggaaaaaatatttgttcccagacaggttgggtgggagtataattcctatgacatttctagtagacattctgtaccaaaattgaagattgcatgtcctttattccagcaactcagcttctaggaacatcttaatcaaataattaaatcagtacaaaaagatgcatatcaagaatgttcctcgtaatgattttaatcataatctttttttttgtagatggagtcttgctgcaatgcccaggctggagtgcaatggtgcaatcttggctcactgtaacctccacctcctgggttcaagtgattctcctgtctcagcctcccaaaaagctgggattacaggtgcccgccaccatgcccggctaattttcgtatttttagtagagacgggatttcaccatattgggaactcctgacctcaagtgacctgcccacctcagcctcctaaagtgctgcgattataggcgtgagccaccacgcccagccaatcataataacttttaaaaaggtggagggaagcaaccaaatgtctaccagcaatgtgaaggtgaagatagaatataagtagccatttttaatttatttgatgtaatatttgaattacaaatataattttcatattttttcagatataactacttgtcttgatatgatttattgaaaacatcattttttgcccactgctttgcaatgtcatctaaattcttacatacctcttgtctatacatgttcctgcaaggaaccagaatttaactttttacaaattaaagaaatttcatacatattaacattaatctgctttttctaagattttctggatgtattttaaatactctgtgaagggaaaccaaaaaaaagcaaagaaagcaccaaaatttgccactattttaacagaaattttattaaataaacaaaatttccaattcttcaagcctgggtgacagagcgagactctcaataaataaataaataataaaagttacagggatggaaagcacaaattcagaaagtgggagtgatgatgaaacaggttaattctactgtcatcacttcgtttccagccacttgaggatacaatagcatatatcagccactggttccatacataagctacatcctggtggacaacacccaaaactcttagggtgtcattccaaaacctctgccttagctgagcctttactaagcaatatcatacttctatcaggatggctgttttaggctgatgccttgtatggtaggattaattgatcccatagagcagtggtccccagactttatggcaccagggaccagttacatggaagacaatttttccatggacagggttggggggcattagattatcgtaaggagtgtacaacctacatccctcacgtgcgcagttcacaatagggttcccacttgtatgaggtctaatgctaccgctgatcttacaggaggcggagctcaggcagtagtgctctcttgcctgctgcttacctcttgctgtgcggcccggttcctaactttgttgggatagagatcttgggtcttggaggtggcagacagttccactggaaataatgatgaacaaatgtcttaacatttagtcctccaggagacaattctgggagcattccatatgcttctcagagttattggaagaatcaaatccctgttgtccatagcagggaccttactttcacctgcttacattggcgtttctccttctttatctcattatctccagtctctcatccctgcttcctggaatcacctcccaaataaactctataacccaggcactgtatgcattttacataacatgtacatgacatcttacactgtaccctgccctctctcttcctagtatttctgtttcagccggaagaggaagcaaatgaagattgacttgaagattagagagttgaagtaatcttcatttattcactttggatgaagattgtagggtcaatatctaggtcctggtattctaattactaaatagatactatgtttatggtaaatgactgcaggtctgtctatcctcaaaggaagcagaaaaccttggattctgctgagtttttatccagtgggagattccctcaaaaaagtttaaagagtggtggaagactaaaatttgctacttaaaaattatttcttaagatgtgctatttagcataccagctacattgactatctgggcatggttcagatgggttctgtctgtgcttcagggtcttttgctgtaatccaggtgtcagtgtgcttgcacctgagctttataaggatgtgtgaagtggtctgtggcctgttaggaacccggccaaacagcaggaggctgtgttaatacttaaaaaaaattagcttttggtttggttaatcctttctattgtttctttttgctatttcattgattgcttccttttatctgcattatgttcttcctcatcattaaaaaattattctgttctttgctgggcacatggctcacacctgtaatcccagcactttgggaggctgaggtgggtggatcacttgagcccaggagttggagaccagccctggcaacatggtgaaaccctgtctctaccaaaaatacaaaaattatccagtctcataagctggtctcagaataaataaattaattaattaataaatagattttttaaattatcctgttcttattttaacatcttcagttagacacagtcaatataagaatttaaggctgggtgcagtggctcacacctataatctcagcattttgggagcctgaggcaggtggatcacctgaggtcaggagttctagaccagcctggccaacgtggtaa[131 bp omitted]cacaccactgcactcagcctgggtgacagagtgagacttcctctcataaaaaaaaaaaaaaaagaatttaaggttctagatttccctgcaagcttttttttagtgacctccactcaaatctacattttagttgatgagatatacaaaaaaacctgatactgcaaaagattatttaatttaaaatgtagtaaaggctacaaaggagaaattcacataatacaggagtagacaatgtctgtgggttagagagcgcttcttctgggaagagatatttggacagtgctccaaagggtggtgcagaggaggaaggggaagaacacttgaagcatagtgtgaggcgaagagaattataaggtgttccagagctaaagtaaatgaggaggagaaagacttgcttcccacactggaggtctctctgagtctggaggtatcacaacctctccctgttgcaaggtccctggtacccaaaacaattttgtcacacacaccatcctgccccttgtgagtcctgccagcccagctttcaggggcctggcccctgattccttcttttcttatcagggtcattcagaatccggaatgactcttatttccacagagcttcaaatcccacctctctctgaggtagaagaccaacagggcttgttttctggtcacaaccctgctgatcaaaacaggatctgatccagacaggatcaagtgaagaaaccagcaggaaccagcagatggggacaaatgtgatccctggctgccctcattgctcatagcgtaagatactcccatagtgccatgacagttttaaaatgccatggcaatggcccagaagttaccactcattttctagaaagctataaataacctgcccctcaatttgcattgatccactccttaatttacatgtaattgaaagtgggtttacatgagtataaatagttaccaagagtctatagtttgctgactcagggcatactgcctatgagttagccctgctctgcaaggagcagtactgttgaatgaaagattgttttctgataccaccagctcacctttgagttctttcctgggtgaaggcaagaacactcgtaggttaagccccactttgggggctcagctgtcccacatcacctttggtgagaggaggaccaactgtggggattgtgaattcaaacctcctgaaagctaatgttgatgggaggtgagccagtgaaatggaaatggcacctgaggcaagatcctgtctaagtagagtttagccctttgcaggacaggtgcaatgagtgctatgagggagataagaacaagtactgtgggcagagaggagatggctgctcaccctggacagtgggttcagaagtagcctccaggaggaagcgaacattcagtgtggatctgatagattagaattggcagccaagggtgaagaggattcctctggtcagaaggaacagtatgtgcagaggccagagagtgtggtgcagtttgccaggtttgagctccagtcaggcctatgaatgacatggctggctagttgggccttgtttgttatggtgaagcatgttgtattttccaaagatgcccattacaatatctcccatcctactttctcttcttactgcatcactcccccatcaaaaggtggactctatgtcccctcccctgaaacctggatagaccttcatgactgcctcaactaaaaggatatggtggaagtgaggccacgtgactaacaaggcctgggcataaaaggcaatacagtctccgcccagctctctgtttgaggatgctcactcttgggacctggacgccatgccatgaggaagcccaggctacatgaggaggccatgtgtggacattgtgggtaaaattcccagctaaggtcctagccaacagacatgtgaataagaaagccttcaagaggactccatccccagccaccacctgcctgagtgtggaccgcctataagtgaaccttcagaatcatgacagataataataataaatgatgttgctttacaccaataaccaataaagatggtcaaatagtgatcaaggagaggaattccaagccaaaagaaaggtataggtagggtttactaccaaaccaaagaaggaggagttccagcattgcaggagggaaggggagggcagggcagaggaggggaggggagggaaggaatggagggagagggacaaggtaagaagaaggcagactggcaagcccacactggatagtgtggtttccatgaaggccactaagtggcagcattggcacaggccagtggttgtcagactgactttgttgttgctttgtcaggcgacctcgctgtgaaggctcagtgtctgtggctgcaaggtaaagaaggcctggctgatagcaagtgctgaggaaggcctgggaaggcctagctcttgctgatacatcaaataatgtcaacctcccacagctgttaactcgagtcaattcatttgtggtggacgtgttgttttttcttctggtcctcctttttctcataacaaacacttcaattttcctttggggaactataccaccaccactcaggtctcctgtatacactctcataggctgtgcactgcataactccagagaatccatccattcagactgtgatgagtggtgcctactggaattgaggagtgcccaacctgtacaactgtcaataacagcccttgaaagatggtccaagttgcccattgtgctcctggtctagatacaagcacattgtctgaaccaagcatatcatggatttgattttgaatcctgagtagaatgttcatcctgttcatactgacatgaatgctgtgaagcaactgcccattagctccagctacatggatctccagagttctccctggttcttttctttttttgttttccaactccaatagaaatcaaattcccttttgatttagttcgccagagatgctttctgttgctagcaaccggagaactccaaaaagtcacaatctgtgcctcaaaactttctcaaggaaccagatttcagcaaaaggtcttgggtattaagattaaaactagtctttattcattatccattcatttattcatccaacaaatattttgggggtacctactatgtgccaggcatggtattagattagaggactcagcggtgaagaagccagtcatgcatggtcactgcctactcagaatctggtgagaaagaccacagtatgtagatgattacagacagctatagaattccaaatggggggaagtattgtgaaagaatagaatgaaatgcattttaggcttgctacaagcaagcagtttctacctcttataacagttaatcctcagaacaatgctacatgttaagtaatactatagatcctatttcacaaatatgtaaactaagcttacgttaaatataaatatacatccaataatttataaatagaaatagaaatagaattttcccaagacttgggtctttcaatgctagaagtggggcagtcctgggcaaacagggacaagttgtcactctaataaataacttgcctgtgaccacactgttagagagtggtggggtaagtattcacttcaggtctagttttaccctgaagctcatgcacacaatgactacctgacaggtgcccttggatgttgtgggcagtgtgtggggaaagggaggagagtgggagaggctggaggcaagcagaccaaagaggagactgagacaatggcccagcacgcaatggtcatggagaaggaagtaactgattcgatgtgaggggtggagggggcaggagatctgggatgacccagggggttaggtgtaggagggggatggaagtggtctgggaggaggaagaattcaggttggccatgttgggtttgccatctgggtccaaatgccagtaggcagttggagaagaatctcagagttagagaattcttgtagctcagctgggcatcgtaggcacttcaaagatgatgccaacagggtccctgctctcagagcttcctgttaggttttgaagggaaggcgagggttaaagaaagacacgcacacacacagagggtggctcaacagcaacataggtatattgcaaaaacctgcagaagtaggggaccagcttaatgccagagccctctgctgattacaggctggggtacttataggtatggggaggaggggtctgggcagtatggcttgctgcccaacaggatattgaaaagatgtgcttatgatcaggtagtctggccctttctccagtgggatgtgaatagggttttccttggacttttgcccagcaggatatgatacggatgtcccttcagttgggcccttgcctagtggggtatgataagaatgcttatagaggctttcgaggaagcatggccctactgacagcttgactttggacttcgatcctccaggacagcaaaagaattaactcctgttgtttcaagccattcagtttgtgttaatttgttacatcatctctaggaaactaaaacacatgacatggtccttcctacctcagagcttgcgtacttgctaccctgtacctggaactctcttattctgactcgatagatggctggttccatctcatcccttcagatctccactcaaatctcatctcttcaaagatggctcctccaagtattccagctaaagtctctcccttaagttactctgtaccacaatgtcttctttaattttctttataatatttatcactttgaaattattttatggattttttgagtatgtgtgtgctgcctgtttcatcccaagagagtgcagcttatataagaagcacagctgtatacccaagacccagacatgtcctttatatattggaggaacttaacaaatatttgttaaatgaactgatcaagcaaagactcacaatggtcaaaaacggaaatttgcacagggttacaccactaggaagccacagagtttttatttaaacacaggctgtctgagtccagagcccaagctcataactattatgcaattacgctatactaactttgatgcaagggagaaataaagacaatttgggatgaggtcctattaataagggaagagacagaaaagagattaattctaattcagttattggggttgagatattacacaatcagctggaaaataaggtttgatttgtggagaagccctgacctggaagatcagccttaatttagggccagaagaaatctcagtagaactcagggtagctgtccttcacccctggtgctgaatttaaggttagtgcttgataaagccacctcatggcttttgtgtacaaggtctcaagtcattcctcctaggtactcatttcccctccactacctgaccttgttggggcaactcttccttcattgctttgcttaattcctgagctggcttatttagtccattgggcatcttccctgtctcctgtcccagcttcagtccagtttgggagaggaaactccccttcacagaatatctataaatgaacttataaaagatttgaatctattaatatactataggattcagtttacaaaggcattagagaaaaaaataagaaaaaatttcaccactactggcatcgatcattggtttaacttctggtttttctttcagcaggagaaaggcacagcagttgttttcagagaagttcagcaatatctccttgctgacaaagcttcaatttcaggtcttgcaagtgcttcagatcccctgagggcttgctgggacccctatttggtctgcatttcagtagtccctactataggccttggatataagaaccctttatcccccatcccctgccaactgaaagagcacacaatggtcaaagctagagcaattcggtaacaaaataaagtggtattagattataatccaaagtatgaaataaatatcatgagcccatacagataaaaaataagtgactcaataataaataaatgaggggagaatagacaaatcatatttgcagaatttcaaatcatttatgtagctacttctccctcaaggaggtaaagcattactccccacctcttaatgtaggcagtatctagtgacttcctcccaaagaggaaggcaaggaaggaaaagattagcttcacagtgaaggaagcttctggcaaacactccctcagctaggagatgaaggctacatcagcagtggtaagtcatggtgataatatgcacccttgatatgatgtattgagaataaagtctctccctttatggggttacaaccttattgctttgcagtctgtggaggagtttacctctgtgatcttcctcaaaaagatccataaccccagtctaatcacaagaaaaacatcagacagatccccattgagggagaatctacctgagcagtatgcctcaaaattgtccagatgatcaaaaataaggcaagtcagagaaactgtcactgccaagaggatcctaaggagatgtgataactaaatgtaatgtggcaccctggacagaatcctgggacagaaaaaggacattagatcaaaaccaaaggaacctgaataaagtgtgggctttatcaaataataatgtattaatgttggtttgttaattataacaatgtaacataaatgtaagatattaataatacaagaagctgggtgtggggtatataggagctctttccactatcttcacaatttttcaaaaatgtaaaactattctaaaatttaaaaatttattttgaaaaggaggggggaaacttactatctcagcttaacaaggagtctgaagtaggcaacagcagaactggctgagccagtaaattatattatcaaacactcagactcttctcatctttccctcgtccatccttagcttgttaatgtttgccctcaaacctgtcttctcatgattacaagatggctgccacagttccaagcatcatattgacatgaaaccatgtttaaagacaccaaggaccatttctctttatatgtctctttatcaggaagaaaaatctttttccagaagcccttctggaagatttcctgtaggctccattggccaggattggggcacatacccaatccccagctgcaagagaagccagaagagtgagaaccaggaatctccaacctccacaatgggaagccatcaagaaataatttgggggtggggcaggtaatggtgttgattaggcaaccatcagtgtataccacacatgagttctccccattacacctgagttttctatcagaatttctagcatcaccttctacccattgggctgagttacagataactgaaaatgctggtgtcttcttttttttttctttttctttttttttgttgcccaggctggagtccaatggcacaatcttggctcactgcaacctccacctcccgggttcaagcaattttcctgcttcagcctcccgagtagttgggattacaggtgccaaccaccatgcctggctaatttttgtatttttcatagagacggggtttcgccatgttggtcaggctggtctcgaactcctgacctcaggtgatctccccacctcggcctcccaaagtgctgggattacaggcttgagccaccgtgcccggccttggtctcttcttaagaatctagacagcatcttcactagtcttgctccctccaaatctctctcactctttctgtttcctgtgctttttattcacaatgttaaaaggctctccacttccccttcttgtctgttataccctaaccccttgtgttatatcctaagttcccacactccagccccaaatcttagtcttaaactaaggaaaccttcaggaaaccaaatcaatttttttttttttttgagatggagtcttgctctgtcacccaggctggagtgcagtggcacgatctcggctcactgcaacctccacctccagggttcaagcgattctcctgcctcagtctcctgaatagctgggattacaggcacctgccaccacatccggctaatttttgtatttttagtagagacaggatttcaccgtgtggtccaggctggtcttgaactcctgacctcaggtgatctgtctgttttggcctcccaaagtgctgggattacaggggtgagccaccacacctggccccaaatcaatatctataagagggaaagtagattcaagcaatgcaattctgtgagttaggtttaattattcaggcttcttttattgcaagtgacagaaacacaagtcagattgaacaaagcaaattagctcatataactaggaaggacaagggtaaagcaggctctgggaaaaactggatccaggaattcaaacaaggttgtcagaattcccagtgtcatctctgtctggctttattctctcctgttgcaagctttctacgtgtgaaggggacacaactgccagcagttctggggttacaactttattactttgcagtctatggaggaagagataaattctccctcccagcacctatatactatcccaataaaggtcactaactgggctgatttgggttagaccagtgatgctatccagggaaatggggaaccagtgctaggattagggtggggtgactcaggtacctcagtgcaaagtttaatgaggcagtcattcttgaatgcatttcatgaccccctgagtgagtggctccttacgagtaaggcacctggggcttcaggttcatgcaagagtgtgcacccccttagcttctatgccctagccttctggcttgagcaagaagctcaagccctgtggggaactgtggttggtcagacctatggacaggaaatgacaaggtcctgggattgggcatcagagttacatgaaacaggtattggtggaatagtggttcctctgcggaaacattgaatgatgttacaagaagtgggaaagtatgctgggcagacaaaaataacagaggtccactagaaaagtatctttctgatccccatcttgtaaatgaaaaaaatgggactcagaaagtgacatggattgtccaaagtcacaaagctggtaagtgactgaactgggagctgtaactttcatattaatgcaatagattccaaagctcgtgctcttttccttgcacaacactgtgtgcagtgtatgtgcagggaggatgtcctggaggaggggaatgatgagtttgattagcttttgaccaaaccagctgggatgaaggaaaggggtagcctcagacatgtctatgtgatgaagcatggacagtgcctgttttcctacaggctgtgctatgcgtgacaggatctcttccctctttgccagcttgcagttggtgggggattgtgtgtgataagggttgaggagggaagagaatccttgtgctgcttctgcccacttgtccagtgaccatgtagagggtatctgtccctggccccagcctcaccagtcctggtgtgccatgaagtacttatggcagatggaaattcatctcagcacagcctggtgcagctccagttttagcatgtagctaaagttaaatgtacttaagaatgcaaagaatatcaattttaaaagaatacatttgtaatagtaaaaatggtatacagtagaaaacaaaaatattaaagacaataatacactaatgactcaagtttgggaactgttcacctaagtcttcatgtggctaacagtcacctaactaggttttactcacctcaaatgccctctcttccttatttctgcccctgcccttgcctccctccccattcctgggatcaacagttgtcatccaagataaccctagaagtgacataaggagccagaagttgccacccattttggctccaagcagaacagacatactattctcccaggtgggcatggagttagagtcactgggaaatctgtttccccttgatgacagcagctggcaaatcaccaatgtcagccactggatcctttcctagggtagttgctgtcagtagcctgatgtttgagagtcaggtcagcttctcctaaaatcacagtttcctcagctcagggcccagcccaaatgcccccagtccatggcatgtgattcctagggtgggaatggaggcaacacctggctgggaataaacagaagctgtgctgtgctcagagggtctccattcactcagtcattgaacaaacatgcactgagcatgctggactctgggaatgctgaaatgaacaagatcgtcattgacttgtttactcacacagtcatttattcactcactaggatattctttccttccacagacatttaccatgggcctagacatattgcagttttacagatagctctactcccttggcttcatttagataaacaatgaagtgacaaagtccctgagagatgatgtgatacctcaaattcacacagttctcagtgtatgagctaggatttgaatccagctcaggctgactcaaaataaaattgccactttatacaatattatttccattcctccttccccttcttcctggagtggcttctggagaatgcaaacagatggacagcctcctccacccagcccttcacagctaagttcagaaaagctcctgatctttgaaagccaaagccttcacttgactcctcctgctcctctgtagcagatcaccttttccaaggatgctccaaagatgcacctcacatgctcttttgcaatgtgatcttgaccttgccactgctagtcaagaggtaggtctatgtttctactcccttgaatctgggtgggccctgggactcctttggtggaagccatatctaataaggatgctgtgctctccacttccccttcttctctgttatggattcaggattctttgattgcaagtgacagaattgtcacttcccagcagcccccaggagatcaaggtgtagccctgagctggcctggcagcttttgctcccgactgtcagagtcccaagttgccgtgcaagatgttcagtctactgtgttcaggccgtgtgaaagagttctggggcccagacactgtaagtatagaggctatcaggggtgaccagcccagtcatgcctttaaagggctccagtccctgacattctctgtttgttcccatatgagaaaccccaagtgagaaccacccagccaagcccagtcaacccacagaactgtgaaagataataataaatcattgccttgagtctctgtgctttggggcagtgtgctacccagcaagagataaccaagcacactcatcctgcaacaaggtgagcctgtaatagagaaaagattagaaatatcttgctccctgcacccacccccagtttatggatattttggttttgttttccttccctttaatggagcctaggacaagtcaggtgtggagaaaggaagacatcaatagggtttagaaagcctgaggaggcctcatggggcaggattgccctttgaggccctagtatgggcatttttggcagaaaatttcaggcagagtaggaggtgtcagcactttcctgcattcaaacattgctcctctctttggaatatgctttctatgggagcaaagaattgtctgactttatcaatcaaggcgagcaagtaaattaactgactgaaagttgctatggcataaagttacttcattttctcacatggaaagaggccaggaggtaggtgattctgagaggaaagcagcagtgaacatcttcatcaagcacccaggacttccctgtctttctgctctgtcatcctcagtgtgttggcttttcattcttaggctcatcccaagacagttgctgcagctccaaaggcaagtccctgtgctcaaccatgctcaagacaggatgaaggggcaagaggtcgatgctagaaagagcaccttccacgtctacctcattgtcaggtagcagaagactttccagcagcccccaggagacatccttgcatcacattggtcagaattgcatcacatgattactcccagatgcagaagaggctgggaaaaagagtttcctgcaaaggccattgggacgccttgattgtcctagaccactggccctcagccctggctgtacattacaatcaccggaggggcttctatcttatttttaatttttctcttagagacagggtctctctctgtcatctaggctggaatgcagttgtgcaatcatagctcactgcatcctcaaactcctgggctcaagcgatccttctgcctcagcctcctgagtcgctgggactataggcatgcaccactacacggggctaatttttactttctaaaaaatagatatcaggtctcactatgttgcccaggctggtcttgaactcctggtctcaaacaatcctcccacctcatcctcccaaagtgctgggattacaagcgtgatccaccatacccagccatgaagagctttacaaagatatagatgcctgggccctactctggattaactaaatcagaattaccaggaataggcccaggtgtcactattttttaaaaaaataccccagattattctagtaagtactaggattgagaagcactattttaaaccaatcatgattcagctcttgaagctagagagggacttacatttcctacataccaacctcctcatgatatagatagggaaactgaggctcagagaggagaggggtttacttaatatcacatagccaggtaatatcaggtctccttgatctcaaacagtttctccttccacctggggagcaactacactgtggaaagaggacactatgcaagaaaagtcgtttggccttgctgagaagctgtgattcccaacggcttgtcccaaacttggccccgatctagggtccaagccagtttcctctcaggaggggaaacatccatcttcccggggaagcacagtgcttgcagcctgacacaggactggggccagagggaaactgcgcatgacggctgggatggggtggggtggggtggggagggaacttcagctgctgtgaagaaaaagagctgtcctacattagatctgtgtttgctgcagagcatctgttattgcactgtttgggggaatcaacatcctagaaggaactcggatagccatcacctggagctgagtctccaatctcaattcccaatctcatcccagccctagccatcatcttccctccccagagctaaacagcactctgaacttgggatttttaattctcatgctttttaacaaaaaaattttgtgtgtatccataatatatatatatatatatatatatatatatatatatatatatatatatatatatatatatcatattgcatgctcttacattttctataaaagccatcatactgtatatatcctttggcaactgacttttctctcagcatggtattttttttttttttttttgagacagagtctcactcagtcacccaggctggagtgcagtggcacgatctcagctcactgcaaactccgcctcctaggttcacgccattctcctgcctcagcctcccaagtacctgggactacaggcgcccaccactacacccggctaaattttttgtgtttttagtagagacggggtttcaccgtgttagccaggatggtctcgatctcctgacctcgtgatctacccttcttggcctcccatagtgctgggattacaggcataagccaccgcgcctggcctcagcatggcattttttaaagctttatctgtattggtacatgtaacccagatgatatcatttcagctgttctgcagtggtagttctcaatcttggctgcatgttataatcacatgattttaaacatcctgatgcccaggctgcaccccaaaccacgtacatcaacgtcccagatggacggtactgagtttcagtgttgttgttgttttgtttttgtttttgactcttcaggtgattccaaggtgcagtcaaggctgagaacaaatgaaataaatgataatttgatgatgcattctcctatgattggctacttagtttgtcatgcattacctaaaaatcatgcaataaatatggtagacaaaaatatataaagtatagtaaaacagacacccacatacctaccccacaacttcttaactaacacggtgctaatgaaggcttgaaactcatccctcattcccgatctcacccttttcttcttgacaaaagataatcactaaactaagtttggtgcttattatttccaagcatttctttatactttcactacatgtatacatgcctctggattatataactatacatacatatatggcattgttaaaaattattttaaactttttgtaaatggaatcacactctatttttctaaaacttgcttcaaaaaacatttgtgaaattcatccatgttgttacatgtagctctagctcattaatagtttttctgctgtatgttttcattccattgagttgaaaataaccgattttaagcctatgctgttgttggatattggcagtttaaaaataaatatttcttttaagcatcttgaaatagccatgtaagccagcaatgattacatcagattcattataattctctctttttttgtatatttttgaaaattttcaaaagaacaagtgagagagtaagaatgatcttgatattttcctcctgtgtaatgagtcactgaggtgtggtgtaatgagaaatacatgggtctggagttctgggttaaatcttaattttaacttactagctgtgtgaacacaagttgctttgtttctctgagccttacttccttgtcttaagaattggaataataacagattctaccatttagagttgttatgtgcatgtcatgcttgcaaagaacttagcacagagcctggctatagaaggggctcagcagatgtctatggaatgaatgttagaaatgctagacattagttcccatgaacttggaagttggattgattgatgcaatccctggggcctatgtgaggcctctctgcctagctgcaagaaggtctgggaaagtgagaaattggcattcttagcttttcttgtgggaggttgtcccaacctcataaagagaggggttgctgtgggtagcaaaaaagaaaggccaaaggccacttcacttcactgaacttggcccagttggcttcattctccatggatctcaatttttttaatctgcaaaatggaagaaataattgacggtagtggccgctccggatggcctgccattgctatcatgctggctgcagcagggagatgctcccagtgccataggctcagaggagcctgccggagctggggacaaacaggagccctgccccctccaagttggggcaggagctccccaggcacagctgcagccacccaacttgccgctgcagacccaggccttctgctccatgggcagggatatccatgccgtcctgggggtagctgcagccatccaaactatgactgaagactcaggcatccatgcattcttgggggcctggtaaggccccgtgccctcacaggctcaggagtgcctgctcctgctgcctggcttctctctgctgtcggcagccacttagatctcagagcaaagtctgcctggtaccatgaagacagcaggaagcagatggattcctgggaggaggaggacaggtccctggtaatgcttcaccttcaggccaggcagggcctggagtctgggggccaggctgccagtcctgtggaccagagtggggacttgtggtgccttttctggccctggcatggacactaatggaccaatgcacaggcacttccatccttctgaggtttataaaagccctgggctcagccagagcagggagaggactgagaggaagggatgaccactgcagagaggagctacccactccagagcctcttctctgctgagagctgcagacgtgggaacaaactgcctacagagagtagctatacactgtaggtctcctctgagctgttctaacactcaataaagctcctcttcatcttgctcaccctccacttgtctgcatacctcattcttcctggatgcaagacaagaacttgggcaaaggcaccatgggccacagaggttactggccagaaaagcaacaacccaaagaccccataacataatgactttgtttttattgtgaggttgaacataaatgaattaatgttctaccacatgataaatctaagtggtagaatctgttattatttcattcttaaaacaaggaagtgagactcagagaagcatagcaacttatgttcacatagctaataagatgcttaaaataaagctatagcaatcatcacagtgtgatattgacttaaggatagagaatttgatcaatggaacagaatagagattccagaaataaatctctacatttatggttactttatttgtgacaaatatgtaaaggcaatttaatgaggtttttctcaacaaactgtgtttgatgaatcaggtatccatatataaaaaacaaacaaaaacttagactcttatttatatcatatacaacaattaactcaaaatggagcctggacagaaaattaagagctaaaactgtgaaacttaaatagctgggtgtggtgccacatgtctgtagtcccagctactggggaggctgagtcaggagaatcacttgaggctgggagttcaaggctgtagtgtgctatgatcatgcctgtgaatagccattgaactccagcctgtgcaacatggtgagactgtctttaaaaaaaaaaacttataaaagaaaaatcttcaagaccttaggttaggcaaagatttcttagatgagcagcaatagaacaatctacaagagaaaaaaataatagagtttatcaaaattaacacttctgttctttgaaagacaccaccaagaaaaccaaatgacaagccacagactaggagaaaatatttgcaaataatgtatttgttgaaggattcatatccagaatatgtaaagaacacttaaaactcaaaaataagcaaacaacctaattgaaaattgggtaagtatttgggtagatatttcaccaaagaatagatattaagcacataaaagttgttcatattattagtcattagggaaatgcatatgaaaacatccaccagaattgctataatttaaaagaatgatcatatcgaatgttggcaaagatatggaaaaactggaaccctcacacactgctggtggacatgaaaaatggaacagccgctttggaaaacagtctcacaatttcttaaaaaattaaacatacactttccccactactcagagatttcacacctagatatctatccaagagaaatgaaaacatatgtccacacaaagacttgtatgtgaatgtccacagcagcattattgataatagctccaaatgtccaacaactggtgaatagataaattgtagcatatccatacaatggaatactactcagcactaaaaagagacaatcgactggcacgtgctataacatgaagaaacctcaaaaacattgtgataagtgaaagaatcctgacacaaaagactgcctattgtaggattccatttatatgaaatgtccagaaaaagcaaatctgtagatacagaaagcgatcagtggttgccttgggttgggagtaatggaagaggagaaatggaaataggtataaaagaacattttaggatcatataaatgtccttaaaatggaatgtagtgatggttgcaccacactaaaattcactaaaaattatcaaactgtgtaattacaatggggggattttattatatgttaattatagctcaataaagctgttttaagaatacttataaagtgtgccaataaacaagggtcattcttctccgatcctttccaatgctcactacccccactcttctgggacttgactcagccacgctcggacttaggcatcaggacctgcagctcacacttggaaaagctcagatgcagagcagctgaggaacgtgctgacattgttgccatagccagcaagtgctggcgtggggattggaacccagacttggaactcattttcaggtgaggagtgaggtggggcaacaggggacttcattcacctggttcctttcccccttggccctcctccctaggatggtcccgtggcagccagcagcaggcgcctaacactgctaagtttccaagttcttagacaactcaagatctccaactgggaggccccagggctgactcctctgcccccgacatgggaaattagggctccttccccatctcacttgtttggaagcctaggactcttccttggataggagaaaggttatatttaccactacgactctaggccaaaaccgcaatcctctctgaaccattctcatctgtgaaacgggcatgttgatactcatttgcccaccccagagggttattaggatagaagggggaaggaagagccaccatgcaggggtcccagccctatgttcttctcttcctgtccagagagtaagatcctgagactaagtgtggggttatcagcaggcctggaatcaaccttcactttttctctttccttaggcatggcagccacaggtagtctggtgagaagctcctgaaaggagtcggggcctcagacaagcagtctagcaactcctatgtgctcttttctgtcctttaaaaacaccacatttgtgcagtttcttatgcctggaatgttcattcctcttccattgcatggttggctcctctcgttcttcatgtctcagttcacaggacatctccccagagaggcctttcctggccaccccacctaagattgctccccatcctcttcctattacctatctagacatgaagtgatcttgtttacttatttttttagcttgtttgctgccagtctctcatctagcatgcaagctctctacagagctctctacagagcttgcataaatggtattggaagagcttagcaaggggattgacacaaagtagatgctcaatgaatatttgctgaagaaatgaatcaaatgttagtggaaaccaagtaaggatcggtcgagacgtgcttctcatgattacccagcatggatgaggaaggttcttctatacccactgagggggaagggaacctgaggctcaggaagacctggtgacttcttcaatatcacatagttactaagtggtaggacctggacttagtggaacacagacctttcctactcccagtcttatattctctccagcatatagcggggagaagatgctgttggagccccacccacatcctcttggcaattgcagttctcctacaggcagcaggttactctcctgtaagcccgtgtgactctgcacctgaaagcattttctctctgtcccaaacacagggcaggctggaagtgccaagggagttatagctccaggagcatcctgcagccagtgtgtgaaataataagatacatattggtttataccccctgctcctaacatagagctcctataactcctgtagatatgggtgctaggagaaccttttgttctaatatttggtctttgaccatggatcctgacacaaagctcctgagacctttgtaatttctggggtgataggagagtctgacacagagcttctcaatcccttgaagtttcctgggtaatggaagtatcactggaaagaccaagccatgattagaggctttgaactttcagcaaccctcatcctcctgggatgagagaggggctggggattgagttaataattgatcatgcctatgtgatgaagcctccataaaaatccctgaactacggggcttggggagcttgagttgctgaacacataggggttcctggaggatggcatgctcctagagtgcatggaaccaccatgctccttccctcatactttgccttgtgcatctcatccatctggctgttcattggtgttctttgtaatatcctttctaataagtgagtaagtgtaaataagcatgcccctgagttctctgtaccattacagaaaactatcaaacccgaggagggagtcatgggaaccccaatttatagttggtcagttagaagtgtaggtgacaacctactacttgtgattagcacttgaagtgggggcagtcttgtgggactgatcccttaacccgtgggatcatactcttaccttcaggtcgataatgtcagaattgaattgaattacaggatatgcagttggcgtaggctagagaatggtttggagttgaggaacacccccatatgttttggtcacagaagtgttctgtgctgagtgttggggaataaatacccgggtttcctgcctcactcttgggggacaactctggtacagattctacactaatttgcagaggtgcccagagagactgagcctcagtcacccacagcagctacctgtttgataatgcaacctgtataggcttttcttcctgtcttctctcatttccctactcccctactggtgcttccaggaatcacctcccagttaaactaactgcgcataaattcttgtctcagggttgacttctggggaatctcagctctattgttacctatgcatagcaaatgaccacaaatgtagtggtttaaaacaacatacatttcttatctcagtttctgtgggtcaggagcccagatatggtttagctgagtcttctgctttagggtctctggctggttacaatcaaggcgtcagccaggtaggtctcgagtcctaagtgaagacccaactggggaaggatccacttccaaactcacttagaaggctgttggcagaatacatttctggggcctgccgtttcttctatatgggcctcaccaacatagcattttgctttatcaaagcacgcaagccaagcagaaagcaacagagaaagtttgctagcaagatggaaattatgattacatgtaacttaatcacagaaatgacatcccatcacctttgtcacatttgattagctagaagaaagtcaaggtcctgctccattcaaggagaagggatcacacaagggcatgaataccaggaggtggggatcattggcggctattttagatgtctgtgcaccataccaactaacagacatctaaaaactaaaatcttgaaagtagcccatgtaatttaggagttctatatctgttctaaggaaagcttctgatgtaaacaagaagccatgcacaaagatgttcattacaacattttttataatagcaaaaactagacaccacctaaccatctactaatggggtaactgctaaataactaatgacatatcaattctctttaacaataaaaagtagggccatggcatattgttgaatgaaaaaaacaatttgcagagctatatatatggtatcatgttgtttaaaacgcaacaaacaatattacatatttctgtactctatttacacacacatgtatgtatagaaaaataattgaagagtacctaccaactgacaatcttggttatgattgtggagccaaagaaggcaaactgacttgagtgtggttgtcaaaggggattttacttttatttgagagaccagttaagttcataaaccatggcagctagactacttgggtttaaatcctggctctgcggcttattggctgagtgactttgggcaaaatacttaacctctctgaatctgtttcttctcctctagaagaaggacgataataatgccattgttaaattaattttagcttaaggctgcctccttacatattttaagtttgtcctaaaggtttctccatacatagtgaactacaaccttcctggatgtgtaaacagagtgtaacctactcttgtaccaatcactgtgtttcaaccaaaggtagccaactgttcaaactgtgtgcaaataaggcaaatgccaagctgtaaccaatccagctgtttctgtacctcacgtgtgttttctgtacatctctttcctttttctgtccataaatattatctgacgatgttgcaccccccagagttgctctgaacctattctgcctccagggactatgttctttgctcagttatactctgctaaatttcatttaagtttttaattaaacaagtatttgttgtttatctgaaattcaagttgaactgagtgtcctatattttaatttggcaaaatctaatcctggcaatggaaaggccctgaaggaatttgaggcagaggaataacgtaatctaagatttaataaatacgtttatttataaaattaaaactatgggttactataaatgagtttagaggattttgaggcatataaataagttccaggagcatttcgagaaattcatgatgcaaggtctccatctaacaagtagagcagttggtgcagatgagatgagcctgatcgccaaccagcctggaggaaccatgagctctctctgcactccttgtcttcgcctttgcatggttctttaccggttatccaggcctatcatgcccagtatttccttccatcctgaccacatccctgcgtgggaagtaggtcacatcaatggtaaatatgctgtcgttatgcagatgtagaaaccgaggctcagagaggtgaagtgacttacccaaggtcacacagggaggcggcacaggaccaaggttacaactcaggtctctgcaactccaaagctctttcccttctccctcactgctctcggttcttaaggcatccagcctgtagtctatccatgccggaggcttgcaggcaggtctgggtgtggggacgcaagaaggatcccctaggggcagctgctggccttggtgcctgtcgtgtcttcgctggagccgggcgtgcaggtggcggaccctcctcgcctcctgggctgtgaagaaggaagcggcgatggcatgccgcaggcggcgggcgtaggcctccaggagcaccgtggagcccgccaggagctgcagggcccccgcggccagcggggcagctgcgcggggacgccgggcgggtagcagtgggcagcgggcggaggtgaggcggagctcccattggtaggagctgtggacggagaggaaggggctctccggagccagctggttgaagaggaaagggatgaagcccaggacagtgtatgccaccttgggaaaggagaaaaaggcagggtcaactgagggcctctctggccactccccacctctaggagaggcttgtccagctttccctgccttcatctgcaaaatggttacagaaataacccgtttcccagggtttgaggaggacccaatgagactaggagtctgaaacaggttcttttgccaaataaaaatcaccatacaaatgttactaaggttagtatctttgagcagaatattttagagaaaacaaattgtctatggatgtttgctccttgctgagtccttactgaatactttagatgtcctattccatccaatatacacaattctatgggtcgagcccaggaggagcctaatttaaaagatgggaagtggccaggcgcagtggctcacgcctgtaatcccagcattctgggaggccgaggcgggtggatcacttgaagtcaggagttcgagaccagcttggctaacacggtgaaatcccgtctctactaaaaatacaaaaaattagctgggtgtgttggcacgtgcctgtaatcccagcttctcaggaggctgaggcaggagaatagcttgagcccgagaggggagggtgcagtgagattacaccactgcactccagactgggcaacacagcaagactctgtctcaaaaaaaaaaaaaagatgggaagcccaaagccacacatgggttacatgttgccaactcagggatcagtctcagccaaggtgggtccctatgtcctgcttataagcactgggccctgcagtttccataggtatgtccaggtgaggaagaatggtatctagagaggcagggaagaaagaagttcaccatttgaactttggaaccaacctgggttggattctgcactaacccaggtgcagaaggatagcttgccacaccccaaatggttcaaatgaatgcaggagaaactcccaaagctttcagaaaagatgaaataatgtgaaagcaatgagtgggcctgtacaatttatgctttcccagaggatcagagagtgccagcctcaaaacttgctgagtgagggcccgcagcttgcaagaaaatgctggaaacaatggtggggcatcaccggggctctggaaggcacagagaatgatattggaggaaaagcctcagagactgactcctcggccagagtcattcagaaaagtcagattgaatgttttaggaaaaccatcagattacttcccctccctcccttccttccttcctcccttccttccttcgtccctccctctctctctcattccttccttttttctttcttccttccttcctttctttttctttctttctttctttctttccttctttcttttctttctctctttctctttctttctctctttctctttcctttctttctttctttctttctttcttcgtttcttcctttttttttttttggagtcttgctggctcaggttggagtgcagtggagcaatctcaattcactgcaaactttgcctcccaggttcaagcgattatctcacctcagcctcctgagtagctgggattacaggcacacaccaccatgcctggctaatttttgtattttcagtagagatggggtttcaccatgttgttggccaggctggtcttgaactcctgacctcaggtgatccacccacctcggcctcccaaagtgctgggattatagataggcatgagcctccatgcccagccccctatttttctttttatgtatacgcgagaaagatatggcaaaataaacctatgttaaataataagtgaactattttatacaaatacaataaaaattctaaatgataagaaagcattgtgtcaaggttgaattggtagcattttctgccctaaggatacataaagtaatggtgtgacttgcaattgatgactatctgagatttggtgaaaatgagtaaatcagggaacatgcttagaacattgcctgacacatttctttactgtgacctatggtaagaaatgcattttacaggccaggcatggtggcttatgcctgtaatcccaacactttgggaggctgaggtgagaggaatgcttgagcccaggagtctgagaccagcctgagccacatagtgggacaccatctctaaaaaaaatattaaaaattaactgggtggtggtggtgcatgcctgtagtctcagctacttggaaggcagaggtaggtgaagtgggaggctcgtttgagccaggaggtcaaggttacagtgagctgtgattgcaccactgcaccactgcattctggcatgggcaacagagtgaaaccctgtctcaaaaaaggaaagaaaagaaatgcattttacagtaccttcaaagcagagattgttttgtaattgaagaaaatattcaaaaaccatacactcccttattgcctaagatgtaatcttataattttccagttgattctatttcattaaaaacactatttatgactccttaaattgattaaattgattttgtgcagtctgaaaagcactttcttaatatgtaataagtacttgataaatataaactgttaatattattagctcgaagtttgacactttgatatgttttatgcaatggacttttgtgtgagacctcactactaaaaattaaaaataaaaagatccgtggcaaaagaaaggatcgaaaaacacaactcttgatctgatagtaatatatccgattataagtcgatagtaaatattttctatatcactattaaaatagcaaatatttcaggctttgcaggacatacagtctctgttgcaattactcaactttgcctttgtagggcagccacagacaatatattgacaaatggcatggctgtgttctaaaaaagctttatttacaaaaccaagaagccattggatttgtcctgaaggctatagttggatgcctcctgatcaaggccattccaaagtcctcctccagtctgacatagacagatgtaagctattaataatagccactctttattaaataatctcttatgtgccatggagcttactaggtactttaagacaataccacattgtaagacacaatagccttttaggattaggaggatcgattcaatttgtacaaatgtggaaaatgaggctaggacaagctgccacttgtgaagggtgaccttggatgcaagttattttaaggtgtctgggtttcagcatcctcaactgcaataggaagtgaaaatagaaaccacttcctagagctgttgtgggtatccgatgagtccctctgcccatggtatggggccccatggatgattcaagggctgtttcttggaggcaagtcaaatttcatcacaagtcaagggtttaacagattctccccctgccctcaaaacaatgactcccttcccttttcccatcatcacacttacatcatacttgaccgtgagcgtgatgggcacagttggcaacttctgagcccagtccacagtagcctgtgccaggaggaaggctacatggtctgtggccaccgccacagccgtggccacgaggagcagggcaagcagccccagccttagaagacaactcaacagctcctcctgtgacagcctcagctgagccgcctggagcagccaggtgggtggaggggccaggaggtgtgtagcctgggcctgtgccaaccgctgggtcagctgttgagtggcgtagatattgtcaaaccgcaggtctgtcaggtagcaatggaggtaccatgccgactccaccaggaggcccaacataaacagccctgtgaccactcgctgggtccctagcgctgctgcccgggccagggactccaggccagagaaatcctccaggacctgctgagtgaccctgagcatgtgaaggtagaaggcagagccattgtcctgggcctcaaatgtcaggccccggctgcctgcctggcctgtggggcccagagccctggatgctgcatgcagctggtgagtggtattgaggagactctccagggagccctcggtgacacacctcagcacctgcccggccgcacccacgttggccaggacgttgggcaccacagcaatggccagggtggcagtgctgtaggacaggagcagccggcggccctgctccatacccagggtgggcacgctgagtgcaaacaggcagcggactgggggtaccaggcccaggctcaggaagaccaggaggccacagacagtggcaaccatggctgaaggtccaggaggataaagcagcaaggatgccagccagtgataaaccagacctgcagcagcagcagccagggaggcacacaggaggagctgggtcagcagctggccacagctggctggaacaggctgggagaaggcgtcccaggcagcctgcagtggggcaagggccttccagaaccccaagtgccaggacctccacctgcacacaaggaaattgaagggcatctctatcaggaggtgggtgggtgggtgtctgtccactgcccctgccccacatacccatcaccaggctctgctaacagactccacccttgtagttacccaggtggaccaatcagagtaagtcactgtatacccacgtgacacaagctgaaccaatcagagccttccccaggattactctcgctggaactgtcagggaagagcccaattcccatgcagtacctgaggatgtgaggatgaaagtctgccctgtttgagtccattattacagttttgtgaaggcaactggcccaagagaatgaaagagtcatggagcgagaagcacaggtgaaagagagagaatgagtaagaggagagagaagaagagaaacgatttcacttgaattaatagtcttggtggcttgctgtatgattctggaccttctattctttctgaacttcagggtctcctctataatttaggggtgaggagggtgaactagttggcctgtgagggacttttatattctatcatccttatatttattcattcaacaagtgtttatcaagcaacgactttgtgttaaccattggagaaacaggaatgaaaaaaacagaagtccctaccttcgtggggcttgcactatgttaagagcgatggcagaggagtagtaaggaaagcttggattctgaacacattttgttggcagagtcaacaagatttgcagaggctgattggttgtggggtgtgagagaaagaggggagtcaaggatgacgaggtgcttttgtgtctgagcaactggaagcaccaaggtgtcatttcctgagatgagaactctgtggtcaaaacaggtttgagtggagggggagagaggaggaattcagttcagaactcttaaatttgagattcagttgagccattccgtggagcttttgacgacgtggttggaaatagaagtcaggaattcagaggggaggtcaggctggagttataacattgggagtctgattattagatgtctcccaactttatatccctacctaaagccatgtgcaccatgagattcctcaagagagtgtgtcactggggaggaaagacatccaaggacatgcctcaaggcgctccaaggttaggggctcttagataaggaggaaccagcaaaagagactgagaaaccaatgtggtgcttaggaagccaaataaacaaaatgtttcaaggagaaaggagtgatcaagtacgtcaaatgcagccaacaggtcaagaatgatgaggactgagcaatgcctattagccgcttagaggtcactgttgaccttggcagggagagttcggtggcttttggggccaaaatccaactagactgggtccaggagagacgggaaggagaagaataggaaacacagatacagacaactctttccggtaatttctacactaaaacagcagggagatgaagcagtggctggtagctatgggaaattggaccaagagaattcatgtaaagggaggaaatctatagcatgtttgcaggtgggagatctcatcgagaggggagacattgacaaaggggagactccctggagtgacacctgtaggggtggaggcagagagtgagactgagaacatgcaaggtggggctggtcttagaatagagcaggggtcgttcatccttaatagcaggtgggaaagcagaggaaataggtacagatgatggcgaatgaacaggcagcgtgtatgcacctgtgaaaagtatcctctgatatacgcagagcagagtaatgttaagggcatgacctctggactgcctgggctcaaatttctgctccaccacttgccagctatgtgaacttgggtacatatcacaacctttctgtgtctcagctgtctcatctgtaaaatggtgcaataaaagtatgcacctcctggggtcactttgtttctggcacatggtaagtatcacatcagctattacctaccactagagtcaactccaccggagcagggactttgtccgttttggtcactgatatgtcccaagtgcctacaatagtgtctgccatgttgtgagtgctccaaaactattcattaagagtagcatgaccgattgcttctgtttgctcaggttggcaggaagcaaggtcagcagagaaggtaagatgctggcggaggtgatggatgcttgaagaggaagaagaaagtacaaaatggttgcccaggaaagtgggagaacaaacgaactggggcaataacatatgtgctgggcaacactgaggcccacttgaggttggagatcatacattatcttaagtgagagcaggcagaaaggttatacgggaatatggttataaagggcagggagggtggtggggaggctgtcactgtgttggttacaggcaaagctgctgacttgctccaccatcaacagcttgaaggataagcatgtgactgggtctagttgatccaagtacctctgatcccctggccaccgtgactggtgcagggattgcacctgaccggagatggaccaatagagctttcctcaggattttgctgcaacgacaaaaaaactgccctttgttgccttgagagctaagctggtaggaagatgcctcaagccttggggaccaccatgtagtatgagtcggcctgggatgaaggcaacacaaggaaaacagtgttaggaaacagacagagagtcccagtggccttgttggaggacctggatccagaaatgcctgaagccgaaatctatgccggaccacacactaggagatgtctgtttttctacaggcagtgtaagatcaatctgtcacttgcaactcaatgagtcctgactaatacagaaacctttgtcacagggcttctgggacaataaaatgaaataatccatgtaaagaagtttacacagggtctggcacagaagagggatcctataaaactgcaccacttgttactctgatgatacttatgtcaacgatgtaaatgtttcactcgagtctcctctgtgcccaggctctgtgctgacccctgtggacacaaagatgaattaagtcctggtcccactaaaggagttcacagtctaattgaggagacttaaatagaccattagagtttaagttcattaacaaagaattctgagcatagtatgcctgggcctggactggggtgggatagatggagagtgacccagttttacctgggagtcaggaaggctccctggaagaggtgacattccagctgggggtggaaggacaagtgtcagtttgtgggtgaagaagggagttggacatccctgacagaaggaacagcgtgtgcaaaggtcctgtgctctgaccatcgggaaatagggagttgggagaaccagaacagtgggaagctgagatgcagtgaggcctgtggggctggagtgaaggtcacaaccttgaagccctaaaggctgaatcatatgcaaatgtgccttattgtggcccactctgtgtgtgtgtgtgtgtgtgtaagctgcccccatttggaaataaggaagtttcacattaaaatctgggtttccagcttttcttgagagataagaagatctgggttagagctcccacctttgcaacaggtagctggagctgagtatccactacccacctttgacaggggagcagccctgcagactgcatcctgctgatcaatgaacgggtccgtctgcacacccaggtggccttccacaggtgcaaccccttcccagctcccgaaggcatttgaatttgggactaaacacccccttctactatataattaatatttggaacacagtagcttttggaataatagctaataataaaaacaattttaaggattgaaagccagtcctaagtcatattggatgacaattcctgcacggggtattgaaaatggcaaggaaactagctgctgtttagtgagtgcttcctctgagccaagcaggtgccaagtactaagcatgtgttttctcattcaattctggcaacagtcttgtagatgtcattattacttccatttcacagatggggaactgaggctcacagagaactgaggatttgcctaaggtcacatagccaaggaatggcagagctgaagatttgggttcatatccatcacccccaatggctgactgttttctcacctgtagccctcagtgtccaaagtccccagacctacccggtcttgacaagttgctcagctgctcctgggtggcctggcatgctgtccaaatggcagtggtttcaggcgggcggtcgctggcagctgtggcaggtggagaggaagtgggggaatcgctgggacttgggaatccctgccacttctgcttttccactctttaatgaagctctcctggctgccttgtcccgcccttttcggggcccacctcccagagggttgggcaagctgcctcatcctctgcccacaagcaagagcgggtggaaggtgtgggaagaggaaaagacagccttttccaagcgatgtctctaatcttggtagcaggaaggtagaattagccccattttacagagaaggaaactgaggcacagagaaaccatacagcttccctttccctcccactccatagttgtgtgccccaaggggagcctgatccctgctcttgggactcacaggtgataatcagacccctgccaagtactgggagcagtggctctggtctccttccccagcccccttcctgtctttagcctgacttgtacctcgcttcaaatctcagctctgtccctccctagctatgagaccttgggcaggtgacctcatatctctctgctggttttctccccttaaaaaaagtttaatgaggctgggcacagtggctcacatctgtaatcccagcactctgggaggctgaggggggtggatcacctgaggtcaggagtttgagatcagcctgaccaacatggtgaaaccctgtctctactaaaaatacaaaaattatctggtttgtggtggtgcatacctgtagttccagatactcgggaggctgaggcaggagaatcacttgaacctaggagacaaggttgcagtgagctgagatcacgtcactgcactccagcctgggcacagagcgagactccgtctcaaaaaaaaatagttaatgaaaataacagttaacatttattgagcacttactatgtatcaggcattcttctaaacaatttctcttcaaattcactgaacacttactttgaacatccctttatggtaaagatgttattttcattcttcagctcagaaaactgagactcagagagctacgtcgccaaccacgccactcagctattaatggtactgccgtgatttctaaccagcgggctggcttcagggtataccagttagccactgggctctgctgctgtggaggggataattcacagacctcgtgattacttcatagtacagctggtactgcaaatagtaggtactcaataatgtaaattccccacgcacaccctctgcagttagtgccctgcaggtctgctttcaggctgtcctgaaagccagttcctacctggaatgcagacacctctccagcatctctgtaccccatcactcccagcaggcctcccctgagccccccaggctccccctctgtgggatggaccagtaggggcacagccactttcccttataaggacatgttgcctgggtcactctcaggcctgaaggggaatgtcctgcggcctggataggggaagtgacgttcttatagttacacagcgattgaatggaatacctgtggccagaaccctcagagggcctaacacacttcccagacagtgcacccctgcaggatgttaggccagctaccaggtctgcaaagaactaagtacatgaggcagactagcagcagcaaacttgtgtacccacaggggccacgctgcttagctcatgaacaaagcaggatgaatgcaaatagcagtgagctacaaagtgtagccccccccactccctcctgtctggtcagctgttattcatctccagttgagggtcaaagccccttgaaaacgaggcccaccatgaccagattttccagcttttctaaagacgccagtcattctctttttaatgtaaatgtcagcttttttttttttaaatgaaagactaccatgcagaccaatcttaacaggtctatgggccaaagccagcatgaggagcatcaattttcaccttccgcaggaggccttagtcaggcctgctgttagctgtctggctgcaaggagatgtctagctattccccccaaactgcaggggccctggactggaggcagcagacctgaactcaaatgccagctttaccacttactgtgctgtgtgaccttgggcaagacactgtccctctctgaagttgtgcatcctctgctataatgagggtaatacagtacctactttaaggactgtttgaggattcaatgagataatgcatatagagtgttcagtaaacaataggtaaatgctcatgccctgtttcctcctacctgggatgacagttctgccaagtgagcccctgtctgctcacatctgattgttgagacttctgatgctcaccaggccaccctggcctggatcccatcacatagcaaacttcagggcattgtgctggtcagacagaaagagtcctagaagccagccaccagcatttgcccagtttctgcacaggcactagggagctggttggataaggaccaggcagtttgtttccggaaggcctctggtggatatgtaagatttgggagcatgggggcatagggagtgaacaggcaaaatatatttttggcttttctcggtacatgtaggcagttacctctgtctatataaggctggcctgacctcaaggcccacaacatccggaaggggcttctgaatcatcaaaaatagaatcagctttgttgaggggaatttgtgggtggaggattcagagccataagacagaagaggaagaggaagaggtaagccttcagatcttcctggagagcctggtctgggatcagaatcagagacccatagagtattattttcagtagagatggacttttgccttgttgcccaggatggtctcaaactcctaggctcaagtaatctgcccacctcagcctcccaaagcgctgggattacaggcgtgagctactgtgcccagctgcacagaataattagagtcactgaattctttagccttcttcaacgttgccactgtccagatagtttgagaatacagagaagcagccaaaatcttcctatattgctggtgctatccaatagcaacagtatgtgagccaccaactcgaaccgtatgcataatttaaacttttctggtaaccctactcaaagtccactgattcaaatgttagtctcatctaaaaacaccctcacagaaatatccagaataatgcttgaccaaatatctgggcactatggcccagtcaagttgatatataacattttttaaatttaaaaaatcgaatttttaaaaacagaaatcaattttaataaaatattttagtcaatgtaacatatcacaaatatccttttaacatgtaaataatataaaaaattgacaggatgttttacatttattttctcatattacaattttctacttataacaaatctcaatttgaactagccacattacaaatgttcagtagccacacatagcaagtggctactgtgtcacacagggcagctatagaccatttccatcattacagaaaggtcagtgggtagtgctgctctaggccattagaacccgtgaccgctaatgctgaaatggacctcccagatcatgcaattcaagggtcatagattcaaatgctttcacaagccaggaaagtgacagagttgacagaggagagccagtgtaagtcattaaagagtggtggggactgaggctaattaatgtttacgttccaacttatgatttcctccacatactactcagctccaaacaattgttgccagatgccaaagagggtctcatattgctagatctggtattttcctttccaagagaagcagaaatccagatttttatgtgaaatctcctgaattttaatgactagcaaataataatttaaaattcatcaggggtctggcacagtggctcacgcttgtaatatcagcactttgggaggccgaggcaggtggatcacttgaggctcaggagtctaagatcagcctgggcaaatggaaaaaccccgactctactaaaaatagaaaaattaggtgggcatgatagtgatgttgtgcacttccagctactccagaggctgaggtgggaggatcacctgagcctgggacatggaggttgcagtgagctgagatcacaccaggccagtgcactccagcctgggccacaaagcgagaccctgtctcaaaaaaactaaacttaaaaaaccaaactcattggggagaggacaaacaaaacctggctgagggctggcaccagattgcaagctctgatgtgtcaaccctttgtgccttactcttctcaaagcttgtttctccagacccctccccatgctcctcctccctgccctgcacccgggaggtggacctggacaggctgcatcaaagccctccttgcattctggctggtgttggtgcaacacataaaatttcatgtgtcaacttggctgagccatggtgcccagggatttagctatgcatcactcttgatgtttccgtgagtatgttttgagatgagattaacatttgaataagtgggttttgagtagggtggatcacccttcagaatgtgaatgggtctcatccatcagtgggaggcctgaatattgcaacagactgacccttcctgagcaagaggacgctctgcagcagatagccttcaggttccaactgcagcactttcttggctctccagcctcctggtctccccatcagattttggacttgctaagcctccacaatggtgtgagccaattcctaaaagaaatctttctccttctgtcttgataagacacacacacacacacacacacacacacacacacacacacacacacacacaccctgtttgttggtttctctagggagccctgactccccagaaggagagctgagggatagaggagaggaagagccccctccttcctgcagtcaccaagagccagctgcatccctggacccagatcccatcaggaagcttgctcccttgaggccttgggctgggaggtgctcctctactcttcactccctgatttctcagcactggggtcccacaattttcctgtggtccccctactctctgctgaccttgtaacttgaccttttactaaactctctacaaattagctagtttgtatactttctatttcctcttgagaccccacctacgtgctctcatttctcagatgaaaaaatcgaaatccaaaatagtaggccaggtgcagtggctcgtgcctataatccctgtgctttgggaggcaaaagcaggaggactgcttgaggccaggagtttgagaccagcctaggcaacatagcaagaccctgtctgcgcaaaaaaaattagaaaataagccaggtatggtggtgcacacctgtagtcctttttactcagtaggctaaggtgggaggatcacttgagcccaggagttcaaggttacggtgagctataattgcaccccacactccagcctgggctacagagcaagatccagtctcaaaaaaaaaaatagtaaagagatctgctcaaggtcacacagcatgttagagatggagccaggattccaatgaggcttattgaactccttgtttagtgatttttatttcttctcctttttacgataccatcaccacctctatttctccacctacttgactctatatctgtttggcactcatattggaatatgtctgtgtgtaatctgtcactatgtgtacctgtagttcatcacttctgtgtgttcctgtgttttccttggtggatttcctttatattttatttcaatactctcccggtgatgatcacctaggtggcctcaaacaaccgtggcacaaatatcctttgacactgtctccttaggacccatgaggtagttttctgggtcataggaaatacagataatgaatacccctaattactgccaagatgctggccgggctgacaggatttctgtttccttatatcctaccaggacttattgtccacttttcttatttttcccagtctgattggcatgttgttgaatttattttaatttgcatttccctgcaaattataaacacataggtttgggtatctcttcataatcctgttggccatgtagatatctcttttcaggatgacatttcgtaccttttgtccacttttttcttgggggctatggtaaatggcttccaaacacggcagcccactgtccctggtggatgccgcccctaccatcaagggctggagtctatttccttccccttgaaccaggccagtcctgtgggctactttgaccaatagaatttggcagaattgacgttcttagacttccacatcctgcccttagaggccttttagcttcggtttttgttgctcttgaaggccactatcatgtaaagaggtcaaggatagactcctggagaagctacgtgaagagagaccctgaagtgtcagcggccattgcagaccttccagccctagcaaaactcccagctcacggggcagagacaatgccatccctgcagagctctgtccaaatgcagaaacgtgagccgagaaattgctgtttcaaagttctaagtttgaggatggcttgttatgtggccacaggtaacaaaaacaaggtttggtttggttttgtttgtcttgtcttttctgagttggggtgcttctcatatcttctggacatgagcccttggtgtattccaatgactctgtaccagccctgccatctccttgttcctatgctgccatgagcgtaccgtaatggtgctgccgccttctgcctgcagatctttttcactaagaatggcaaagcccttcaggcttcaaggactgagtaacatccggtcagagcaagctagaatgccttctcaggaaagctgcagagacacctggtaaccagccagaagaggcagactctagatttccaaatgccacaaagttccagctcagagcacccaactaagtgaagcaatctgctcatctgaaactctgcacttgcagtccccttgcctggaatgttctccccagagactccccatcgctcccaccttctcccttcctcccacattgccatgagcatctggctgactccttcaggtctcaatctagtgccacctgctcagagaagtcctctccgtccaccctggctaaagtagcctctgagtcagtttaacatcttggtcattttcttcttagccggcatcatgacacatgacttgtttatgtttctattgcctgtctcccctgccagcttgtaagttccatgtgggcgggacaatgaaccagaacatgacaggttcccaataaatgtttattgaatgaataaatggaagaaggagtgaacaaagtaatgaacaaaacagaccccagatcagaggaagagatggctttcttgttaattctggagcagattcaagcagcaaatatttactgaacacttgctatgtgctggaaattgttctaggaactggagttacagcagtaaaaaaaataacatttgtattttcataaatttatattctagagggagaagaagataataagaaaataagttatacagtgtcctattaaggagaaattatagcagagtaagggggtggagagtaatgagggtgacattttagacaggaggtcagggaagcctctcagggaaggtgacacctgagcagggacttgaataaagtgagtcggggaaccagacatatacttgggagagagtgttctaggcagagggaacagcacatgcgaaggccctgaggcagagtatgtagctggagaggggagggaagagcagtagaaaatcagagaggtcaactctgtggaatccccagcccaggaatttggggctttgaagctctcttatgttcagaaaggcaaatcatctccaggtccaaagttgattaacattctttatttcacagtatttttgatcagaagtcttagaaatcatgattcatctggttacaaatcccatgagtttctctttgaatgaacctcttgcttccagtcccatacaacgcatctcccaccagccccagtgggttgtaactgtgattcaacactgagtgctcacttggaaaggaggtggagctcaacttccaactcagagggcctctcccactgctctcagggaaatgcccatgattcacttatgctgtatcaacaacaagtgcagctgggcgctgccttcccagctggccaagcgctcctaggggaatctccaccctcagaggcttaggaaagggaagtgtgacgagtcagggcccctgggctggtgtcttttccaatactgggctaatgctgggccattccattcagcagacacttcctgagggcctgagctcttcactgggatgccagaatgcttctgcttggaacaaagagggattaacccttgaaggcagacaccacttccagcctcgggctcacggggacgtctcagttttacccatatgcagaaggggacaatcttttgcttgcctgagacattttaccctggccttttacaaggccccaatttatcttttgacttttctctcacccctgacaaatggggcctttgataattaaacatgcttaccacttaaggtggggcatggagagatcaaggccacctgctgggacaagcagcaactgaccgccttgcagccacagaggcctatgggggccacatgtaggagagtcctggctggaggggtcatgagtcaccccatgggagggcaggacccaggcctggcctgaccccagaattatggccaaactgacccagatgaaacaggagaatcctaaatctcttgggtcgagatgtcagctgcggtttctagaacttcccctggtatgctcaggagcccagagaaacagcaaagaggctttgcacagtctcatgtccttggaaagctatctgtccctttccctgtctccaaggattaaaaaagaatctctgactgctggttatcggcaggggtaaaacaactggtgcagaatgggcaccaactaagcaaaatcacacactggttgtgaacagctggaacaactgggttggaacattgcagcccaggaaagtgatctttaaagacaaggtggtctcttcagtgtaatcgaaagtaatcactgggggataatgttagctgtgcccatgggaatgaatggcctcctatcccaactgtacgagacaaacaccatgccagatttgctcactgttgatgacactgggctgtcttgtatcctaatgataaaacagctaactgataaaggagcttatttctcaggcagcagatctgagagatacctgggctttgaactgcatgaaagagagagaaagtatcctagataatggctcatggacttgagtgggccactggaggtcacccttgcttgctgcatattggattacagaaaagaattatttgattgttttgtagtgtcctagcagcaggtgatggtgacagccctttgagagggttcagcctcaagggagtcctccagggggactcagagggtccgaaatgtgtcattggccaaggtgggtggcaatgctgtgacattgaccgagtacatatcagcccagtccgggaaggtgcccagctggaagatggtctgtgcccaggtattcatagccaaactgagcagcaggacacccatcaggttcatcaggaggcctgtccgcacctgaaatagagcccagacagagggaggggtcagcacctgacccaccatacagatggaaacattcagactcagagacaggaagtcactcacccaagatcgcacagccaggaagtgatggagccaggacacagacccaggtcggtaaatgcctgggacccttcaatctttacactaccctaggctgtcactcaaagagctgcaagtgtccccattcattgatggcctctaggttccaggcactgtgtgctacgcagttgtcacagggttatgctgtttaacccagaaagcaaccttacaaaggtcattcttattaatccccattttatagaagagaaaaatgagacctagagaagttgacttgtccaaggtcacctaacttgaaaataatcttgtctgatcactaaacacccccatcccacacacatatacacacacgcatgcacacacacacgcatgcatgtaggaacacacatatgtacacataggtacacacacacacttcaggtccagtccagtcaggtagtcctagtcaagactacccttgtccattgggaagcatttttcttctgtcggtggagaatgtgcccatctgctccctaccctggctggcctcttggaccattcagtccaccttgggctgaaaatccttgttttcccacctgggtcttctggctgccccgccttcacatagcccaggctgaatcacatggtgagacagttacttcctttctaattctctttctgtctattcctcccagagaaagtctctcttaggggtgtgataggaaaataaatcttggggcccccaaattactaagctaaagagaaaagtcaaactgggaactacttagggccaacctgtctcccattctattcagtcatccctctgctcactgagttgaatgcatatctgattgccttctttggaaaggctcatcagagactcaaaataatgcaaccatttgtctcttatatacctatgacctggtagccccctgccctctttgagttgtcccgcctttccggaccaaaccaatgttcatcttacatatgttgattgatgtctcatgcctccctaaaatgtataaaatcaagctgtgctccacccaccttgggtgcatgtcgtcaggacctcctgaagctgtgtcacaggcgtatgtccttaacttaggcaaaataaacttcctaaatttactgagacctgtctcagatttttggggttcacaggggccaccatggcttcagcacttctctgctcctgtcagttgcccttttaacaaggagaggcccagaaccttctccaggcagctgctatcagggagagcttaattcttttgtttttgccgctttgcatttatttttaggtttactggccatggcatatattaataataccggttttccattgatggatgcactggaaacatttcttctggaatattcttattcaagtttttttttgttttttttttttaatgtcaagctgatttagtaaaggtgttaaataaatattaccacggacgggtgggggacatactgcgtgtgctgtcctgcctctcttctaagggcacagaggtggaagccctggcaccttcggaggattagagggagtcgggccgacatgttggggaaactgggggaggattgggtctccctttgccagggctcaaaattcctgctggtcccatgttagctacttcattaacacctaactcattactctcaggagcgaacctgcaggtgggccatccctgcccgggactggctgaccgggggtgccccttgtacccctccacatctcttgcaagtctctacctcttggggactctccatttctctggctgtctttattctccaaatctatgctgtttgcattgctgccctctcagtctttttctctaagtagcctccctgcttccacacttgtccctcccaccctaacgattcactccagccagcagccaaaatgatcttctacagacagaagtgaaatcacatcattgccctgcttaccgagggtccccactgtggtttgaataagataccaagtctgtcctgtccccgctgttccctgacctcgtgtctccaacctcatccttctccaactccactgcagccaccccagcctcctggccctgaatttctggagcactcgctgctattcctctcttccaggcctttgtacctgctgtgccctccattgggactgctcttcccctttttctctgtgaggctggcggcttcccatgatcatcagctcccatgtcaccttcctggagagggcttccctgccacccctctcccccgtcctcttacacttcctcatgttttatttccttctgagcacctagcaatattgaaattttacataatttaggaaaatctgctgaacttgttcacgtctgtctccaccaatagaaagcagcctcctaggaggcggatcggtgtctctcccactctgcagtgcccccagtggctggaacatagaatgcactcagtaaatagtgctgtaatgaacgaacaaatcaatgagtctctgtctcgtctcttctctgtttgctctgtgtctccctttctgcctcgctctcactctcgctctctctccccatgtgtcctgcaggggtcttgtgcctggagggcctgcatcgcgattggttaagcaggtcgcccgtcttggctttgacagctttggaagggttatttgcaaagccagtggagagggaaaaggccgcaggagtcaggagcgggaagggaggagctggttcagcagggaccttccgggggagggaacatattgccaatggctgggccctgctgaaagctggtggggtcctcccactgctacagtcctccgcttctgtctccttcccagctggctgagcactgaggcccacccctgagtcctagggtgtgtctgctgcttctctcccccgaagattctgggcacgaagtggggtccagagggaaggggaagttccttgcctctggagcaaattttggaaagtagtcactaaggcagtgtttcctgagattgtctaagtgcaggaatcatcccagagtctctgctaaatgtatgttcctggtcccactcagaaagatctattcagagactggggagtggggtcagcgtgcaggagtcctgcatagaggccttgcccgcccccttgcggcccacccacatcccggggcctctgctgggaaatgcccagactcaccatgtctttgaccagcaagtgtccagaggcgaaggcgatggagttggggggcgttgagaccgggagcatgaaggcaaaggagcagccgactgtgcccggaatcatcagatacagggggtgcactctcaggcggatggcctgggccaggaaaaggtgggagagacccggagagagaccaacgcagagcgaccacagcaagagggagagagagagagagaggcagttggaaagagggacacaaagacgtagagacagagagacaaagacatccatagagattggcagagtggcagagaacaacagggacaagtgagaagagagagttagagagacagagagagaaaggcagtcagaaagacacatgcacaggcagaaacagagacaagcaggtaagaagagaaccagatcgagagagaggtggagagaacattcccagggttagtgacattcaagggccacactgtggtttgatcagggatgggctggggtggtgtacctagaacactccttctccaatgtgagagtgcagaaaagcacttggagggctggttaaagcccacatggctggccccacctcacccagaattgctgattcagcaagtctggggtgggatccaagaatctgcattcctgacgtgttcccccggtgctgctggtctaaggactgtacactgagaaccagggctttaaaatacttcctctgcctgctccttccctcagccaaacaatctcaacccagagttggcctctggatacctcttgttgggggcatccctggatttcagtgagaaagagagctcatgagagcatctgttggcagctcttccaaatttctaagactgtgtgtatcaaacccccctatgagctggcctcagctagtgggccaccagtttgtcacctctcctgcctacaattcatactgatcacttttatggcgttttacttaaataggatatttttgggccttctagggaatttttgcaacccaaagcatatttattttctcaaaaagctctaaaatcacccccttgcatgtaaaatgttttttgattttgatgataagcaaagtttacaagaatgtgtcatttacaagtgtcttttccagcaaaagctgccccttacagacctggctgggttctatgctccgtctccgtccccataccccctataatactctcatttctctcagtgaccaggtccctctgaggactcccaccccatactgctataaaatggtgagccactttggagggcaatttcctcatctctaacgacattttaaacgtacatgctctttgacccaggaatctcagtcacaggaatttctctagatgtaatcaatgaatgcatagacaaggctcaggtgacacgtcattgttgagtaacagcaaagtctggaaatacctatatttccattgggcagagagattgcttaaataaaccaacaactgtccatttataatggaatattctcccgtcattgaaaaataacacagtgtatatctgtgtgctaacacagataaattgatgcataaaataagcagacagaaaccaaagacaaggtgctgcaggtatgtgtgctggggcatcactgtttgcatacaaagcatttacttgcatcattgatttaattttatcagcgtgggttacattaaggtaattacatggtctggtctttaatctgtttaaatataaaactatattgatagtttcctttttaaaactcctagtataaaagctacctgatcatgtgtatattgttcttttcattctgtcatggtttcattttgctatttgcatttctttttacaggagattgaattatagctttctcttcccttgctctccttacctggttttggggccagggttttgctagctataaattgagtggccatgtctatttttctatgctggtgaacagtttgggtgagttgggaactctctgttccttgcaaatctgctagctctcacccagcaaaccacctggggctggtgattttgtttttgtttttgttttgagacaggatctggatctgggtctgttgcccaggcacctgccactaagcctggctactttttgtattttttgcagagatggggtctcaccatgttgcccaggctagtctgaaactcctgagctcaagcaatctgcctgcttcagcctccaaaagtgctgggattacaggcatgagtggcagagcccggcctggggctggtgatttttagcccaggagtcatcagctgggtagggggaaggatttgttcccctgacggggatatttgggaatgctaggagacatttggattgtcatgatttagggaggcgccacttgtctctagtgagcagagcccagggatgccactacacaccctgtagtgcacggatcagccccatacagagaatgatccagccccaactatcaacagtgttgaaacccctgctttagagggaggctactgctttgcttccattagaatttctcctatggccatttgtttactcagattttctacttcttcttcatccaaaattggtaatttacctgttctagaaaactctccatgtcaccatgggttaattttcccagaagagagaattgggagcactttgaaaatatttactctatgtatacattttttgaaggaaaacatccagtatttaaaaaaattgtactgtggttctgatacgttcatgtattttggaagacagcaatggcaactgtggcccccagtgaaggtcccttggcgggggaagatttctgaatgtgtgttgggggaggggtgctcccctcttccccagaaggaccctcaccagctctgccaggaccggcaggaagatgatgatggtcgccgtgttgctggcaaactcagtgaagaaggcgatgaccacagtgatgagcagcacagccagggcggggggcacattctccagggggtgcagctgcccaccaatccatacagacagccccgattcctgcggagggaaaggcattccttcataccccagcccatccccagctgccgccccccagagagggttaggatagatcacaacaatgacgaccataccccttcccagatggggagactgaggtgcagagaggggaggtgacgtgtccaatgtcacacattcgagccaaggtcacacatctgagccagcagcctctctacttctcgaactgctctccactctatctcatacaggccagggacccaaacccctgggtctccaataatccatttggttctagcacccctaagcaccgatttaagtgggaaagggaaatcaaaccagaccctcagtagtaaaacttctcatccctccagtgaaggttattaattacccaaatcataatagttacttatataaaatattcattatttttataattattatttaataatatattaatatgtatgaaatatatatacaagacttactatatatcatatataaaacacgtatcagatatacatcaactacaacacaatcaatgtaattatcaataataatggtatttatacgcctgtaatcccagcactttgggaggctgaggtaggcggatcacttgaggtcaggagttcgagaccaggccagccaacctggcgaaaccctgcctctactaaaaatgcaaaaatcacatgtgtgcctgtaatcctagctactcgggagactaaggcatgagaatcgcttgaacctgggagggagaggtttcaatgagccaacctcacgccactgcactccagcctgggcgacagaaactctgtctcaaaagctacatatatatatgtatttgtatatatacacacatacagtaataaggataattactacaatgataatactacaaatattaacgttgcattattattcattgtcgtaagaatcaccattattgaggctttacaggggaccaggcacctgcaggcattagctccttgactcctcccaaccatcccaaaaggtaaatattggttcctgttttactgaggaggaacttcagcctgaaaaagtttttgtgacttgcccaggatccctaaaagtagtgcctgagacacccatctacctccataagatgtgtgattctgcaaagctccccgcaaatcagcatcttcctctggacccaccagtctgtcaccttgtctgtaaattaagagcaatgcccagtgctgactccagtcctccagggcagagacgggtagagaagttcaccgagactccactcgcctgtcagtgctgcagaattatttgggtgctctctctgctgacttctccagaagctaccctatttaccagtgtataacatctagaatactcttccgcacctctgtcctctcaccatcaaatgcatccttaaataactgacccaacacatcattataaccacaaaacggcaaagctgaggatgtcaaaatatgctcaatgctgtcccctggtgcaactgtgatgcagcaagatcacaataaagccaccgtttgcttagacctagaacaaagctgtaggttttggagctgatctagggcagagctgggttagtccattaacattcagaatccaatgtattgctaccatagcccttttatcaatccagtataccaaagacactttatatatatatttttacttttaatagaaaagtccctgcttactcagaacttaaaaatttcataatcgattctagaagacagcatacagggccaggcatggtggctcacgcctgtaacccagcacttttagaggccaaggtgggcaggtcgcttgaggtcaggagtgcgagatcagactggctaacatggtgaaaccccatctctactaaaaaaaaatacaaaaattagccaggcgtggtggtgcacgcctgtaatcctagctacccaggaggctgaggcaggataatcacttaaaccagggaagcggaggttgcagtgagctgagatcacgccaccgcactccagtctgggtgacagagagagcgagactccatctcaaaaaaaaaaaaaaaaaaaaaaaaaatagaatagagcatacagtttttacataaataaaatagtacacttgcccctacaatttgacttaaaagttaccttcaatgtaagaataataaatgcttaaaaatatttgtccccagaagagtcctcatgaaactaaggtgtttctggtacacctgcagtttgtctgctagcctggggaatacggtaagtggcagcgtggaggccacagcccctaacctggctgcaaggagtgctgcagggagaaaatgggacctctggtttttcccataggccacagctctggcaaagagtctgacctgacagctctgtgcgcaattaaagggagaggggctagagagagggaatattaatgactcgggcaagtgagaagccaggagctgccccgtagctgggcctctgagtgaccgggcttccagccagcatcctcgcagccacacaggccttggcacagctccagcgctggagggaggtctggcagcttcctaagagaggaaaacgcctgttgcgtagggttctactggggactctaaagggacttcacctgccctttcccattttattttatttatttttttgagacagagcctcacattgtcacccaggctggagtgcagtgacacaattatagctcactgcagcctctatctcctgggttcaagcaagcctcccacctcagtgtcctgagtagctaaggctacaggcacacaacaccatgtttggctaaatttttttaagtgtttttttttgtagagacagggtcttactatgttgcccaggctggtttgaacctctgggcttaagcgatcctcctgcctaggcctcccaaagtgctgggattacagacatgagccaccatgccccagactctttcccatattcttaggaattggaagctttgtttccttggaaacacacagccccacagtattcccagggactccagggaccagcaacagccaaggtcagaggtggcatggccagaaggtgaagagaaggggctctggagtcagactgagtttgcttcccagcttaatcttttctagctgtcacttaacttcctaggcaagtcacttaacctctctgtgctaaaatttccttatctgtaaacgagggataatgatagtgcctgtcccagaaggttattgttgggagaaaaggagtgaatctataaagggcctaggaaagtggctgggcgcttggttagcgcctgccataaccagtagcatgaagtcacaagatgcctgaagtgatggaactcagaaatcacccagcacagtggttgtcaaattatgttccttagtggccttgaagatgaccagaagtacccaaggccaccttgcaaaaatgggaggtggggagatggagttggtacagtgatgtttccctcttcctcctgttttcttacttcaaccaggtcctctcttcttggtgtctttgatatacagtagaggagcatcttataagggggtttgttatggcataagttcaatatttgaagtcaaaaactcctgtggccaaaatacccttgaaaatcttttaaaaggctttgtaaaacacaacgggctcggctgtgtgcatacaactttgtataataattcctaggtaaagagaccagcgaatttgattaaaggaaggaaaaaagacaaggctttatgtacatgtataaacattcaaaccactgcaccatttacaagctgtgtgactttgggcaaattaattaacatctctgttccttgatttctttaagcgattgcagtaaggattaaataagtgcacacgaaacactctctgtacttagtaagcactgaatatgatctatcatttaatttaacaaagcaacatagtgcttactctgtgctgggcactcttctaagtaatttgtaaatattacttaatcttcatagcaacctcatggaatacagactacagatgctccttgacttacagtggagttatgtctcaataagcccatcacgaattgagaatattgaagtagaaaatgcatgtaatacacctaacctacctgttcacatcataacttagcccagcctaccttaaatgcgctcaggacactgacattagcctacatttgggcaaaatcatctggcaatgctatacactgtagaatatctgttgtttacccttataattgctcagcatctacaagagagtgtcccaccacatatcacagcctgggaaaagatcaaaattcaagattctaagtaccctttctattgaatgcatatcactctttcaccattgcaaagttgaaaaatcgtatgtcgaatcgttgtgaagtcaggaaccatctgtacaattatctccattttatggttgaagaaactgaagcataaaaaagctcagtgatttgcccaaataaataatatgacgtgccctagtaagattcagaatctggatcttagtcatgtcattaggcttgtctgtccgataaaatgagggtaataataattgtattagtccattctcgctctgctaataaaaacatacccgggtgtgggtaatttataaaggaaagaggcttaattgactcacaattcagcatggctggggaggccttaggaaacttacaatcatggtggaagtggaagcaaacacgtccttcttcacatggtggcagcaagaagtgccgagcagaagggggaaaagccccttacaaaaaatcatcagatctcttgagaactcactcattgtcacaagaacagcataagggtaaccgcccccacgattaaattacttcccaccaggtcccatgacatgtggggataatgggaactacacaattcaggatgagatttgggtggggacacagccaaactatgtcaataataaagatgacagacttctggcagaaaatgaggaatggggagaatacacattttctccttacctctatcaccgcaacatatttgtaagtaagtttgttgtggcaacagaataagatcaacctttcctcaatgaattaatgcaataataacagtaataataatagtgaagatgagtgtggctcctggtttgagcacccagggtatatcaccactcttctgggtactttccatacattatgttagcaattctcaaagcagcccatcttgtaggtcatagcaacaatgatgtgttaagcaccattacgcacccggtgtcttctaggtgcctagaacagtggtgggtaagacagacatggtctctgcctgccctcatggagcttccattctagtaagagacacaatcaataaacatgcccacaggatcatttggggggtagatgtggtatataggaataggcagggtcatgagaggaagagggactggggtgggaggctattctagatgtgggggcttgggagggcatttctgagggactgagacctgaagagtgaggactcagagctctcaggatgaaaattcaacagagaaagggaagatgcaaaggctgtggggtgcatgtgagtctgatgtggctgaggaaggggccaaggagactggaggggtgttaggagggaagagaggtaggtgccaatgttgagacctacattgtcccatacagctttctgtgttggccaagggaaaccttggacttgactttaagtctatgcagagtcatgactatacggttttgtggcaggagaaaactgtagtgaggaccctaagtgggcttaagtgagttgctgaggctcagagtaagcactacttcctgcccttcagaatgagcgctgggagcccacacacccaggctcaccctggattgcatccagggacctccgatcctcaggaggctgccaggctgtgttctgatgagagtgtggggcaggggccaggaaccaggatgtgccataagcattctggtcgctcctgggccaggctgcggctgcctggggagaggatggtacggcagaggctggggaaaggaacagctactacacaaagcccctgttgaagagaaactccggccagctgcccagggctgggctcagagccagggtggcctctcagcatgcccagcgtcccgcagcccagcctccactgagagccagtgctccccacaccacttctggagcttagggaaacctctggatcagggtcatctcatccagcctccttcctctaggccaggctgggctcagatcactgaggtaaatggcaccatttccaccaagttgctcaagccacgaacctccacatgattcttgattttgattttccttttcctcagtatctaaccataataaccaactgtgctgggctgtgttctcatttctctgcatatattgactcacttaatgatcatggcaactttaccaggtgggtgccgttgtgattccaattttacagatgaggaaactgaggcccagagaggtttagtaacttgacaaagatcatacacctaagaagtgggaaatctgtgattccaatccagatggtctggttccatcgtactgcaagcttcttcaagatctggataacatgccacttccttcaggaagccttccctaagacacccccagcaggaggcaatagcataagtcagatagacatgagttcaaatcttacctctgctactaatgagctgtgttacccagaaccagttacttaacctctctgtgtctcacgattcctaaaatggagacaaataacagtacttttgctcatctattcctttgttccctttgaagtctgtatcgttatttatgtgttttttaattaataaagtaaaacatattttatttaaaaatgagcagctatgtagagagcctgaatgtgccacccagatccccatcagtggagatcttgttgccccagctaagggagtgcagtcggctgtctcagaccccaaaagcggcctcacttgaggtcatacctgcacctggggcagcttgtgtccccagacagatggatgctgggatacaagggcctggctatctctgattactcggactgcctctaaaggtcatctcagctccagtgctcctgtggggctgggactgcctccagctgcatttctccctctgcactctcctgcttccttcctctcccttccacagtgaccccaagggcacaacctaatgaagcccgtgcttccgaatctccatcccagagtctgcttcctgaaagcccaacctgtagaaaccatgacatgaggatttatgagctggtgtacatgcagtttttagcacttcttatcggctatatgtattgggcagttattctttaattttttccaacaaccctgtagagtaagaactttgagcctcaatctatggatgagaaaaataggaacccagagaggttaagaaacctgcctgacgtgtcccagcaaggagtggtagagcctagattgaccaggtactgagattcccaagcctgggcttctgcccagtgtacacagttaacaggcgtccaacattgtaacttcatttgaaactgaaaattaaaattgaattaacaacagaagcagtaaaagaagtaatttcagcttcccttaaccttaatttcagattgactcttaattggctgtggtttttaacgcctcggtttacaaggcgttcaggggtgagacggagctcagccacctgacctttggcttcagatcctggctctaccatctcctggctgtgcaaacgtaggcgagctatttagcctccttttgcctccgattcctcatctttaaaatggagacagtgatagtagctgattcagtggtgtttataaagatcgactgagtcatattcgattcacgaagcacttcaaacaatggctggcatgtgcaaaattctagagtgaacaatttggagcccggactctgaaatcagggagagtttgaaccccagctcccaagcggaatgcaattgtaagaatttaagagagttgcttaatttttcatgtctcagttttcctatctgtaaaagaggcataaaaacattacccaactcttagggctggtgtggcgattcagtgagataatctgtggtgacagatgctggatgctgacgttgcactgcctctgagctgggctggctgacccgcacttgcacgccccggagagtgagcactccctgcaattctgcactccgtgtgcctcatttgccccaccctggtcccagccctgacttctgagctcacaaagccctctggaataacattaataataacatccatgaactaattaatattactatctaggacttatatgagagtggttaagagcatagactctagagccgaactgcctggattctaatcctgactccatagctgtgtgacattaggtaaggtactgtatctctctgtgtctcaagttctttatctagagaatgggcataagaatggtatctaccttctagctttgttgggaggtttagatgagttaacgtgtaaagcatgtttttttctttttcttttttttttttcttagagatgaggtctcgctctgtcacccaggctggagtacagtattatgatcatgactccactgtactccagcctaggaccaccacacctggctaatttttttaaccccatctctacaaaaaaaaaatacaaaagaaaattagctgggcatggggaggcatccctgcagtcccagctacttgggaggctgaggtgagagaattgattaagcccggcaggctgaggctgcagtgagctgtgttggcaccactgcactccaacctgggtgacagagtgaaactctgtctcaaaaaaagagagagaaaaaaagagagagggtctcactatattgcccaggctgatcttggactcctggcctgaagccatccttccacctccacaagcatgttgaacagtgtctggcattgggtgagcgcaatatgttgttatccctctgaagtcacagagccctcgagtcctagtattattagtattagtattatattaatattttgcccatcatgagctccttaaggatccaggccataactcattcctctctttctctgtagcaccaggaatgaactatgatcatctcagtttggcaagtgaggaaactggctgtgcccccagggcccgtgcagctcacctgctctgatcctggtgctgcagccagcactgggacccgcccacacctgcctcccactgttcctgctggttgggggagccagggggtcttacctcacagcctttggccatggcgaagccccctcccaggagaaggatgatgttccagggcactgtctcctgggccttcttccaggtcagcaagggctctgtctctgtgttgggagctgggcagagagagggattcagcacacactcagggccgctcagcctgaggcagaggccaccagccctgagccccatcttaccggggacactcaggggtccccaggaagccaaagtgtggatccagcatttgacttggagctttagggagagagtgcacaggcatcatgataggtggagctgctctattcccagtgaaaataattgtcatggttcccacagcttgggagtttttggaaactccacatgcaggacatcacttaactctcccaacagcccttgggcacaagtgctatttttaccctcatttataagagaaaaggctttctttgtactggaacatgtacagagaggaaagaaaaagaggaaggaaatttagaaaaatagaaacaaagggtatttttgagccccgaaatgatgggatgatttttatttcctcgcaagtggcagcgctgcagtggtgaggacagtgggcgggggagtcaacaaactttctgcagggggttagcgagtgaatcattgaggctttgcaggccacacagtctctgttgtcactactccgtcgttgtagcatgaaaacagccagagaccatacctaaacgtgtgggcatggttgtaaataaaactctatttacaaaagcaggtggtgggttggacctggcacgtggctggtagtgtgacatccctgggttgggggcataggcttggagacagaccttcctcagtcttggcttactgcatgcccttgacaagtgactttgcctccctgagccccatttcctcagccggcacatggcacagttacagaaccggggagtccctgtgaacacgaaccaggacaatgatgcatctgcagggagatgaggcatttccagttagctgatagttgcatccacagggtctagaacagtgcctgacacctgatggtaactccgtaaatatttgtcaaataatgtacatgacacacttagacccatgcctggtgcagggtaatcactcctgaaataggacttttcttggcaggctgtgaccagggaagcagggaggatgggtctgactcctttaaggcagtttaccatctcccaggacacttcctggtcaagcagttatggaaattttgcttctccttttgagctttttccaaacgttacacagtggtctacctaaaacaagattttatagtcaggaaataaagataataaaagctacttaataaaatccttctaccagcaagcatgcagtccacaagtgtatgcagcccacaggtgtatgcaatccacaggtgtatgcagtccacaggtgcatgcagtccacaggtgcatgcaacccacaggtgtatgcagcccgcaggtgtatgaagcccacaggtgtatgcagtctacagacgtatgaagcccacagatgtatgaagcccacaggtgtatgcaacctacaggtgtatgcagcccgcaggtgtatgaagcccacaggtgtatgcagtctacagacgtatgaagcccacaggtgtatgcagcccacagatgtatgaagcccacaggcgtatgcaacctacaggtgtatgcagcccaaagatgtatcagtccacaagtgtatgcagcccacaggtgtatgtagcccacaggtgcatgcagcccatggtatctacatgcaatgcaggtgtcatataccttgaggggattcttgggccaaatgcaacatacacttaagcccagaactggatgaggtaaccagacatggcaggtggcccagccctatgccttcagatgataaaatgtcgtttcattaaagaagtacaagaagtctgaaaaagtgaagcgacttgccccacgcagcaggtaagggtggatgggactggggaaggaagaaagccttgagcagggtcccatgtaatgcagattaaatggcgagtgcgtatcagactgtctgtcacatgccaagtgctcagttaatgttagctaccatgggttttattgttttcccatccaaccatgcctttgctgctatttctcataagcacaatctctgactatgtggatttcccactgcagctcaacctgataccagccgactgtctacagcagtagctgaaggcacaagctttgaactagacttgaatcctagctctgctgtgccccaactgtgtgatttgggccagtgtcactacctttctgagcctcgatttcctcttctgcaaaatgggctaacagcacttccctcggagacttactggaaagaagaaatggtcccactgtgcaaaggactcatcccagggctttgcccagagcaagtccctggctatttatttattttttatttttatttatttattttttttgagatggagtctcgtctctgtcgcccaggctggagtgcagtggtgcgatctcggctcactgcaaactccgcctaattttgtgtatttttttttagtagagacggggtttcaccgtgttctccaggatggtctcgatctcctgacctcatgatccgcccgcctcggcctcccaaagtgctgggattacaggcgtgagccaccacgcccggtcagtccttggctatttatttagcaaatatatattgagtacctgccatgtgtcaaacactcttctgggctctcaggatacagaaatggtcaaaacagagaaaatttgtctccttggagaacttatattccaggggggaagtcaggtgataaacaaataaatatactggccgggcatggtggttcacgcctgtaattccagcactttgggaggacaaggtgggcgggtcacctgaggtcaggagttcaagatcagcctggccaacatggtgaaaccccatctctactgaaaatacaaaaattagccaggcatggtggtgggtgcctataatcccagctacttgggaggttgaggcatgagaatcgcttgaacccgggaggcagaagttgcagtgagctgagattgtgtggctgcactccagcctgggcaacagagcaagaccctgtcttaaaaaataaataaataatgccaagaaatttcatgtgctatgaagaaaaataaaataaggtaaaggaataaagagtaacacaggaagacgcttttctagatggtgtagtgagggaaggtttctcaggaggtggcatttggacagagccctgaatgaagtgatggagtgagtcacgaagatccctagaggaacagctagttggcaaagaggaaagagaagtcgtcgtcgtcgtcatcatcatcatcatcatcatcatcatcaactacttttccaccacaagcacatagtaggtactcaatcaatatttgaatgaccacaaagggtgagaaatgcaagtgcaactcagacccacaaaagaatagtggggtgagtataagaagaaaatcaaggctggcttgaatgcctggttctatgtcctgtctctctctttccctttgtctctttgtctctctctccccctcgatttttcttttttttcttgagacagggtctcactctgttgcccaggctggagtgcagtggcaacatcacagctcactgcaaccttgaactcctcaatcttcctgcctcagcctcccgagtagctggaactacaggtgtgtgccaccacacaggctaatttcttaaatttctggagacaggctcttgttatgtggcccaggctcttcttgaactcctgacctcaagcaatcctcccacctcagccttccaaagtactgggactagaggtgtgagccaccacacctggccctgactctttttaatgagcagggtgaccttaaacaagtcactttctctctatggaaacttactgaccaaaatataagactccacaaaagtctttagtgttaaataccagaaagtatcacatcagccaagtctgcacagggtcactggtggccaaaggacaggcagtgctcatggagttccctccccacccactgggaaatgctggaaactccagttcaaagacccctgggctaagggcacacattggcattccatggaccagacttaacacacatgttttagtgctactgttgttggcccacatagtatttgtttttcaacttgaatgagttgccaatatttaaaaccagggagattccacataaaaatctagatttttggcttcttttgaaaaatcagcaaatctgactaaactagttctgttctcctgcatgggcacaatcagtggaagctaagtaatatccgtcccctttaatttaagtggggattggctcaccaattttccacagaccctgccttgccacgagactgaggcactcatcactacttttttttttttgagacagagtcttactctttcaaccagcctggagtgcagtggcgtgatctcggctcactgcaaccgggttcaagcaattcttctgcctcagcctcccaagtagctggggttacaggtatgtgccaccacaccctgataatttttgtatttttagtagagacagggtttcgccatgttggccaggctgctcttagactcgtgacctcaggtgatccacccacctaagcctcccagagtgctgggattacaggtgtgagccactgcgcccagcctctcaccacttcttactgatctcagctgttgtctccctttgtataataaggaaactgctttctgtttcaaaaatgggaaaggaaagattcacaaggagggccatgtgtttcttgagacacatattcctgtacccaatctgctgtatacaaatgttaccttccatctggagaaaaatataggtcaaatatatataaatatatataatatataaaatagattatatatttataaaacatataaatatatacaatatataaaataagtgttacctccttgtaggcagttgagttacaaactcaattgtaacccctgatctataaagccagtaaaagccagaggtggaaggcatctaagggactccctcattttctaagtgagaaagtaaggctcagacaatataggaccttccctgaggtcacccagaaaattagtagcagagctgagatgccagtcatctatgtcatagtgaggtaggaggcaggactcactccagggttggggcttgggaaccagaccaaattgaggaccagctaaaacaggtcctgggcggaagcagctttccataagacacacccaccagtataccatgtcaatctaccattgccatggcaacacccagaagttaccatcccttttcatggcaatgattcaacaacctaaaagttaacacccttatcctagaaatttctgcataaactaccccttaatttgcatataattaaaagtgcatataaatatgactgcagcactgcctctgagctactactctgggcacactgcctatggggtagccccactccacaagaagcagaacctctgctgctgctgtgcactgctgtgtcaataaaagttgctgtctaaaaccactggcttgccctggaattccttcctgggtgaagaagccaagaaccctcccagactaagccccaatttgggggctcgcctgccctgcaacaatagcgccttccccatgggcccagctgagagaaagccctgggcattgtgagttcaaccccaggtgccagaaccatggatgggcacctgaccaagggcagctgatccataggcaggccagggatctacgaggctgtgaagtagccttgtggaaggagatctgcccaagaagaacaagctggaccaacccgactcttactctcagatgcagcaatgggaaacagagacccactgggcaaagagaagtgacacctgaaggtgaaagaatgaacagagaggctgtatgacacacaggggcatgactgggctgaagttgggtgaggaagcagaagccaggaggaaacagatactgtgaggacacaaaggctccagggaagcagaggctcaaggcatcagatgggcaccatgaggaagtggctgccaccagggggaagaagctaggaaggagcagaaagtatgaggggcgatgccacagggaatagaaaacatgaggaagtggagttggcagaagccacggggatcagacactataagggaacaaaagtagagactaaaatgaagcagaaactataaaggtgcaaaacctaataagcagcagaaaccaggaaaaggttaagaaattgtatacagagggaatgatgagaacagccatttggaagactgactggaaaagaagcagagatggagaaaaactgaatcctgttcaactgcagagtacgcaggcccacagctaagcctccttagacccagttccagcctccctgaggtccagctatgctacaggaactgtctatgggtcgcacatggtggctcatacctgtagtcccaacatttcagaaggcagagacgggagggtcacttgaggctaggagttcaagaccagcctgggtaatgtagcaagacccctgttcctacaaaaaaaatttttttgagacagggtttcactctgtcacccaggctggagtgcagtgggtgccatcacagctcactgcagctttgacctgccaggctcaattcacccacctcagccttccaagtagctgggactaccaggaatgcctcaccacgcccagctattttttttattttttaattttttgtagagatggggtttctccatgttgccaggctggtctcaaactcctggactcaagcaatccacccgcctcagcctcccaaagtgctgggattacaggtgtgagctaccatgcccagcctgctacaatttttttttttttttaaattagccaagcgaggtggctcacacctgtaatcccagcttcttgggagtctgaggtgggaggttcactggagcccaagagttcgagactgcgctgagctgtgatggtgctactgcaccccagcctgggtgacagagtgagaccccattaaaaaaaaaagaagaagaagaaagaaagaactgtttatggagcttgcaaaatcctcatcttcctacaggacacatacactatactccccacactcaaaccctgactcttccatggctggggctatcctgagtgacactatttttctcaacaatagaaaatagtttgattatagtccctatttcctgactccggaggagctcatccaactgacccaggtggcagcctcaggtgttggcgtcaccttctggtagacatctgctggacaccggagggagtcgcaagctggcaatctgaaggccacagtctacaacattttggttagaggtactcagtgattttttaaaaatggaatctgaatgcctttaggcagtttttcctcagtccccaacacttcctatacggttgaaacccagcttgtgttttccatgtgtggctccctgggcaaccaaggtgcaactcctgctttgggccaaggggtcatttttctgcaaaggacaagaaaaataaacattttttgcttttgtgggccaagaggcaaaattgaggctattgtgtaggtacttatataactaaagaaaataaatttccacaaattccttaggggaaagcaaaatttgatacatggacactgaaatttagatttcatgtaactttcacatgtagtaaaatgtttttcttttggtttttttttcaaccatttaaaaatctgaaaactgtgcttagctcacaggctgttcaaaaacagatagcaggctggatttggtctgaagactgtagttgctaacccctgtcctggactaccacctggggcagccctcagtccccagacaaggcaatggctcagacagtgaaaggagaagcaggaaggaccacgtggttagtgcagtggggggctccaggcccttgatgaccacactccatgccgcagtcctcactgagcccaccgagaccccagccttgaccaccttacctttgaagtcaaaccaccacttgagagagggcctttgggacgggaagaagaacaagatggtgacaatagccacgccggtgacagcatcagaaagaaacctacaatgagaaggccccaaatcacgtgaccatgggcatctcagcgggccgaggtttggcagaattgtaaaggaggatttgtggaagggaattaggcctgctgtgaaggggccattgttggaggctgggccactggattctgtccttcagtgcgctcagcatggtgcaaagctcttcattcacagctccctgggggcatttagatgctgcttgggctcaagcaaatgcttatcttcccaactcaaggaccctacgaagagggacttgaccaaagaggggagaatccgagggccgcagaatattggagtccttggaacccctataaatcaccctcaccgggactcctgtaagagccctgtctttgttcagcttgtgcttgaatccctcctgggatgggcagctcactgcattgagatacagcccactcacaccagtggaacccagattgacccagcctcttggcccctcaaaacctaactgtcacgtttcaagcatccacaatgtgtcctttaggggagttttgcgcacattaagccctcggggcaggcactttccatttcaggtggagaatcagagggtcaaagagcagaaacaacttgttcaagggcagaccctgagcaagtcattttgttaaactgacatacaaatacaaccaagataccctgtaaattgtatttttaaagtttttatttgcagcattggacacaattcaataaggaattggttaaataaattgaagtgctcccattctgtagaccctggcctgaaactcagattgttctggctccaagttcaacaaagcctagagctcactgctaaccaaagctctttccactcacacatttggaaaggagagtattcaaacagacaagaagttggaagagatggtcaatatcactatcatcagagaaatgcagatcaaaacactaatggtataccattcatttgccaacaggcaagacttgaaaaggagagtaaaactggtgagggtgttgggaacatatgcccttagtgaaagaataaaccagtttaacctcctggggcatttggcaacatgtttccaattttacatgtaaataccctttgatccagttatcctccttctaggaatttaaccttgagaaacagtcgtacttttgtacacagattatgtgcaacgatgttcattactgataagagtaaaaaaaaattggaagatttttgatagacacatgtttaaagaaattgtgttccattcatattatgaagtacactgcatctgtttaaaaaaagataaaagataacgtcaatctatgtattgacatagaaacacaaccaagacaccctgtaaattttattttgaaagttttgatttgaagcattgaacacaatccaataaggaattggttaaataaatcaaagtgctcccattctgtagagtactatgcagtgttttaaaagaataaatttgtgacctgagtccaagaaaataaaattaaaaaaaaagaatggagtaagtccaaatggcaagttgtccatgatcatattattatattttacagtcttttgttatatgtatacatatttgtatgtgtgtatgtatgaagatatgtgtgcgtatctggaatgtcatacaccaaactgctcatggtgatgatctctgggcagtgggacataaagtggataaagagccactaacttttcctttttcaattcagcattgtttgaatttttatgagtatgcataacttttgaaattcaatacaaaattaaaaagcggattacaaataatatgttgacgtgatcacatttctgttaaaaaaatcttcttttaatagggttctaaaagccaattggcatatgtttcattgaggtataattaacatgcaataaaatgcacccattttaagggtatagtttaacaagtcttgacaaatgtatgcagtccgataacagcgtgatcacaatgtagaacagttctcagataggcattgtttaaaagtcaggaaagatgtatatcagaattagagactgagatttagctgatcttcacattttctgtattgttgaaatgcttataatgcccattttgcatctgaaaaaaataaagcatctacattttagaaaaataaaaaaatggtaagagcaacaagagcttcatggcttcatgaaattatattgtttcttgcttataacaaccttcaggagatcagaatttatgtcacccattttaccagggaagaggttgaggcccagaaggtgagatatctggattgtgcactgcccagtatggtagccacaagccacatgtgggctagtgggcacttgaaatgtggcaagaccaaactgacatgtgctttaaatgtaaagcacacaccagattttgatgatttcacatgaaaaaaagaatgcaaaatatctcactaataatttatacataaaatatattattcatattagtttcatctgtttttcacttttttaatatagctaccaaaaaatttaaaatacatatgtggctcacattatatctctcttggatggggctaactgaaataatcagatttcaccaaatccagcagatacatctctatttaatcatgttcccactcacaccagaatttgacacagtgcccactcacgcttcttaaaacactcccctctcttggcttttgctggtccatagctctaagttttccttctacctcactcaccatctctctgtttctctggtaaattcattttcctttccccagctcccaagtgctggggttcctcatggtctatactctacttaaacactttccatagctgagcccattgattcctacggatttaactcccaaatttatacaatgactcccagatttatgtctgcaacctaaacatctcctctaagctccagtcttgcatatctaactgcctattgagcttgacaagtctaaaccaagtccaaaatagaattatgaataagccattcccagccccctaaaaaatattcttctccaattaaccaccatccatgcaggtactcctttcattcacaccccccaatccaacccagcacaagtcccacatttaactttgaatgatatcttgactgctacattgccattgctaccaccctcactcaagccatcccccagaccaggggtcagcaaatgtctcctgtaaaaagccacacagtaagtattttggctttgcaggccacatggtgtttgtctggactcacatttgacattggagtatgaaagcagccatagacaatatgtaattgaataggtgtggctgtgtgtcaataaaactttatttgcagacactgaaatttgaatttcatataattttcgtgtattacaagacgttgtcttttgatttttccgcagccatttaaaaaatgtaaaaatcattcaaaatcaaatggcgggccagatttggcccaaaaagacacgggccatctagatgatgttatagctcctaactattctcctcgtctatatttttgcccccactacccatttcctaatgaatatagctaacaactattgagttctttttatgagccattttaatcacttgacatgtattaactcatttacctttacaacaagtcaatgaaaaacgtactagtataatatcattttacagattaggaaactgaggcacagagaggttgagtaccttacaaccctccaatggctgcccactgctcacagaaaaaaaacaaaccaaaatgcataacatgcccgaaaagacactctgatctggccctcccctacctttcctcacccgctttccttccttcccaccaggcctcgctcccactgggcttttctcattttctcaaacatgctacgtttgttctgactcaggcttcagtagacattcccagggcatctccactgctttcatctgcagtcttcctaagctttggctcttcccagaactgtccaaagtcaatgcccctgctctattattttatagcataaccctctcagtctttccttcatagcactcattgcaatgcagttgttttgttgtctaactacttgcttttgtctgtgtcccagcatccagcatccagcttagcacataataggttctcaatcaatgttgattgaatgaatgaacgatttgctcagtcacacagctcgtaagtggcagagctagaattctaacccagtttagtctgactccaaatccagagctcccaacacatgagaagtcatattttatcacccaaacctaaactcttttgagagtgaaagagggacctattaataatcatatgggacaaaagatggaaacttggatgcgtgtctccccagctgcactgccgcctctccagctccaggtggcccagcccagaatcctccctgttggactcctccctgtgggtccccagagtctcacccaggattgaagaggctggcccagccagggatgaacttcgggtcccgggtgaagaggaggatggcaaacatgcagaaaaggatgaaaacagcctgttcggcaaacctgtggcacagacatgcaggcatgatggtgaccccgggtttcaggcagaccgcagcaggcacaggctcaggcagctgcccactgggagtgactgggcccgggctctgcctctgagaaagctgaagtcatccactccccagggagtgcccagagtgaggggaggggtgccaatggactgtaaatgattcctgtcctaggacttccacgatccctcaggatccttcctgagcctcaagccaccccctccccgaaatcgcgtgtttcattatcaccaggagtttaccagggtcctacggaaaatcaagaaagtgagaaacagagacagagtccgaaaagcagagaggaagagaaacagacagaaatgcagtaggcaaagagaaagaggagcattcatacagagagagagagagacagaaaaacacacagtctgtctacaccgaaaggagaagacacagagaggggacagacctggagagagggtggatgaaggtggaaagagaggatccccaagagttggaggagacagttacccaatgtacccatttcacagactggagagcagggcccagagagggttagtgccatgaccaaagccacacaggacatgagtggcacagctggtccttgaacacaggcctactgaacccgttattttcaccatatggaaatgtgcattaaacaaggtcccggaagtcacctgagatagtgtcaggtattctgcgtaccgggagggaaacggtgccttgggtggaaggtagcagatcccactgtaagtacactctgaggggctttttggtcctcaggtttctaccccagcaccacggcaagaggttgactgtgtaaaccacctcccatcctccatctctaggctcccacgccacgggtcctggaattcccctggagctcagcccccatgggcccaaggccaggccaggaggaagctctcctgagcgtttaatactcagctctttccttaacccaagggcccccacatacttgatgggccccaggttctggtattcttcccgaattacagctcgagccctatcttctgcattggttcttatctcagatttattcttcctccagcccctgaaacagaaagtgggagattaggagtggccactgcaggtataactaacttctcacctacaacaagcaccaccacctgaccaagccacatcctctctgtccgggaggctgcaactgcctgatagcttgtctccctgcaactgtcttcctttgctacagttgttctccccacgtatagcctggttgatctttgaaaatgtgaatctgatgatatgacttccaggcttaaaatccatgagtgggtcaaacaggcacatgaataaacacaggaatcaatggaacaaaacagaaagtctagacacagactcaatcacaaatgggaatttagtctataataaaattgctatctcagattggtgtggaaaagatgggctattcagtaaatggtatcagacatatagatcaatggaacagagttgagagcccagaaataaacccatccatctatggccagttgatttttgacaggcgtaccaagactgaatagtgggggaaggaatagcctttcaacaaatggtgctaggaaaactggacagccatgtggaaaagaatgaatctggacccctacctcacaccaaatacaaaattaaacccaaaatggattgaagacctaaatgttagagctaaagccataacactctcagaagaaaaggcaggggtaaattttcatgtgccttggaataatatggttagagttaaaaccataaacctctcagaagaaagggcagtggtaaattttcatgcccttggaataggcaacagtttcttcaatattacgtcaaaaacacaagccatcaaagatagataaatttgacttcatcaaaatagtaaaatgttgtgtgtccataaatggtgttaggacactgggtgaccatttgggacaaaaaaaagtgaagttgaatccaaacttcacactgtaccataaggatgaactccaaatagattagaggtttaaatgtaaaaaaaaataataatactagaagaaaacatatgattattcttttataagtcctgtattaggaaaacctttctaaactgtaactgaaatttcagaaaccatatgagaaaagattgaaaaaaaaattaaaacaattctgcagggagaaaagcaccataagcaaagccaaaagacaaatcaggaaaaaaaatgtagcttctattgtagaataagcactcatctttctaaaatataaagcataccagaaactagtaagaacaagaccaaaaacccatttgaaaaaaatgtataaaaatatgaacacacagtttcacaattcacaggaaagaaaatacctatgaacaaacttttcatatgcttccaaacctatgaaaagttgcccaaaattactgttcataaaataaacacaagttatttttctcttatcagattggcaaaaatccactttgctgcaaggaagcagacactctcatacattgttcatgggagaggaaacatgtacgatttttatgaagaatgatttgataatatctattaaaataaaaatgtgtttattctctgatccagaaatcccacttctggaaatgtatcttataaaaatgcttgcttcctttgagctacagctgcaaggtaaaagagaaaaaaataataaaataaaaattaaaaaacagctgggcttgggtggctcatgcctgtaatcccagctgtttggggggccgaggtgggtggatcacttgaggtttgagaccagcctggccaacagagtaaacccctctctctaccaaaaaaaaaaaaaggcacaaaaaattagctgggcaaggtggcaagagcctgtagtcccagctactctggaggctgaggcaggagaatggcctgaacctgggaggtggaggttgcactccgacatggtgccactgcactccagcctgggtgacagaatgagactttgtctaaataaataaataaataaataaataaataaacaaacaaacaaaaatctgtcacggaggccagtcactagaaaaagatatctatgtctgctcatatttgcttaagaaaactctggaaggttacacaagaaaccaataaaagtggatgcttgtttgggaggatatcgtggcagaagaggcccatggttgggaagaggggttctcactgcatacctcttagcgctgttttgatttttgagaagcatatgtatgtattgcctatccaaattaaggtagccatattaaaaagtaattgaagtaagcaaaataaatataggaaaacaaagtgccagtattatattttggctagttatcatttctggctcaagtctctgggtctgaagcttgctctttcttcgtttagaggttgatttggaaatgttagatattaaggtttctttagcacccaactgagactttctcctcaacgtaagtagactgagtgatgagagttgataaagacatatttcccataatatgatttggtgttatttagtattttgtcctcatgccaccccaaattatcttctgtatcagggccccataaaatgggaaatcgtgcactcccctcttctctggtcaagagtgtttaccttatttaaagacaatactattaataattatgaataatatgtgacatcaacagagggtctgtgtgtggcaggcaggtcacacctctcacttaatcctcacatccctgggaggtcaagaaatgaggatatggctagcacggtggctcacacctataaccccagagctttgagaggccaagacaagaaggatcacttgaggccagaagtttgagacaagcctgggcaatatagtgagactctgtctctacaaaaaattaaaaaaaaaaatttaaccaggcacagtggcacttgcctgtagtctcagctacttgggaggctgaggccagaggaacactgaacctgggagattgaggctgcaatgtgctatgatcgcaccactgcactccagcctgggcagcagagcaagaccctgtctgtaaaactaaatgcatacatacatacatacatacatacatatatacatacctacatacatacatacataaaagaaagaaatgagaatacaacatgaaataacaatcatcctcagttttcataggcagatactgaggttagaaacgccattccctgcttccccactctattgccaaaaagaaaatgagaggtacctgaagctcagtcccccgtacaggaaggagatccagagccagcctgccaacaggaacaacagcataagagggaaggcgaaaatgaaccaggagccgaaattcaccacgtcacactgcggaaagaaactggagaacagcgggagatgagaacaggccaagggcagccatgcccattttgggagtgggagaggggaccaggcagtactagtagcagcggggaggaggaatgagagggtcccatggaagtcttgggaacagtgttttccaccaattctaatagaagcacccttttttcctcttctttggaggctgctggcttctgacctagtgggaccaatgggtgccctacagtcaaaatctctgccccctggaggccagacaggtacctgagtgagtgaaacaggccaggctgggccatggtgaattgaagagagccctgctcattaaagggctcagctgctatttgcttccccatggttgccatgcaagagtgcagggccagtaagcccaggtttgggttttacttgaaattatgtgatgtttaaatgttgacaattcatgaaaatgttttaatgaatgtgggagtcacatataacacatctgcaggctgaaacctttgccctccttattacatatgctcaaagaccctgggcattttgtccaggcaatggtgatgtcgatgagttctttctctgctgaacggtgtccaatctcagttttattaagacatcatcaagcctgaaaagatgaagggcaataacactcagtgctggtgaagatgtggaaaaacaggcagattcttgatgtttgttcgtcagaatattcttttctggagaggaatttggtaaaatgcagtaagagtcttaaaaatgtgcatatccttttacccagaaattctactactagaaataaactttaaaaaaacaaccagaaatgtggtcaggaatataagtgctagattgaaaagaggaaaagtaagttatagaatgatgtatacaaaagtatgtggatactcacggacatttctaggtaaataataaaccaaaaccttaacagttattgtataacaaataagcaaacaaaaatattaataaactctatatagtgggattctaagaggtttttatttcctcctttttctctacctgtattttctacaatgaataagtatacctctataattagacaaaataaaaatattgttttaaaaatattaaaatatcagcaagtgtgtggtcagttacataatttgtaatagcaaaataataattattataaaatgaaaacaatcaatgcttatgattaaagcatgtacacccaaaataagacaatacatagtcactaaaaattatgttttctaaaaaattttaataataaaatcagactataaaactgtattaagagcatagtggcaaaaacgttaaatatatacacatttaatatatggacatagaaaagtctagaagaaagtctgttaaaatatcgacagtgggattggaggtatttcaaacttctttttctacattttccaaatgttctttagtgtgccaatatcattttataatcagaataaaccaataaaatgtattttggcaacaagggccaaaggaccactcagggcaatcacttctcctctccccaggcttctcctgttctcagctggagaatcaaaatcacatattacctagcattccttttaaatcccctcttcctacaccagagggtctgcatttgagcccttgtgttgcataagatttgcatgaaatttacttgaaatcccacatttgatatttttactgtatatatgttaatattatatattttatgtattatatgttaatataatatatattacatacttaaacatacataagatatattttagaaaatataaatatgaaatagacatataaaaaatataatttccccaatttcatttcaggttggaacaaagtcctactcacatcagggcaggcaggcagcctgtaaacgctttgacaacaactgctcccctccaattctctccatccccaacctaggctctgctctccatccccagagcccacatcttcctgtccagccctggggatgggtcctggcaaaccctcataccaaatgcctaccttcccccttggcagaacgctaaagggctgagcctagatcctccccacacctgaagcaggaccatctttgcttctggtttttctgtcactgagctaaaaccagaaggcacagccagccttgtttaaaggatagtgataaaaagacatctaaggtttgcagtaaaactcagtgggcttaaatcaattggtgaaatacacccacaacttcttttttttttttttcacctctcccagtgcatggttgacaatcactggtttccatcatcaaatcttaaaatcaaagcattttggaagctgagaatgtattggcaattcatctcactcaggggttaaggttttaaaatcagcacatgtggccaaacatgggtgtactaaaatctcttgtgaaaatacctataatgactcacatgtatgttactgagggttgcacacatagcaaacctctctcggggagatcagcagggcctccctttattcatccccacaggtttttgattctttggttggccaacaggtaaagaagtcagctagtatttgcagccacgttgaatatcaaatactatttggtgtcctttgttggccaaatgcttacatttgcatttatgtaaatcaaatgaacctatgctacatctccactgcaaggaatcttagaaaccctgcctcggaatcctggaacctaaaagtcttaaagacagaatcttgaaatactgaagttttaaaagcttagaaaccagaggtttagaataatgggagcggcacgttgtgcagttggaacatcttttcttttctcttttctcttttcttttcttttttttagagcaggagtgaaagtttattaaaaagttataaagcaggaacatctttcttttatcctcgtgccctgaccggccacccagtcactgctgaccacttccaggggtggggagactttagctcccagcagagcccactccactgggggaccctgcttatggttggaaggcttctcttgggccatgacggccacagacccatgcctcccgctggatcactcctctgctgtgacctttccaatgacccccatctcacttggaggaaaagctggagtccttagacaacacttaccgctataaccttttgtcttctcaccttcccttcgccccaggctcttcgtctccctggttttcttgctggtccctgaacctccccaggaacagctccacctccaagccctgtaggagctactccccactgtcggcaatgcctttccctcctgtgtccacatggctcattcccttctaggtctctgctcaaatgtcagcccatcagagagaacgggtgtccttgaccaacctacataaactagcaccccactctcctcacttctaccctctttccctgctgtatttttttcctaacttatcacacagatatattttatattcatttgctttttcacttattgcctgtctctcccgccagaatggaagttccccaagggcagggatctcactggattttgtgcattgctgtgttcccagagcctggcccagagaaggccctcaatacacattccctggatgttgaatgaaggagggaagaggaggggaggagcagaaccctccccgccggtggggactctcgctttcacctcttgagctggccaagcaggatgaggttaggggctgtgcccgtgagtgtggctgtgcccccaatactggctgagtaggggatggagatgaggaagcccttccagatgttccgacgatattcatcctccttcctggagtcagccggcagatccagtggaacctctgtctccccagggtggtctttgctttaaacaaatccaaagagaagccattcagaatacatggagaacaggccacagactgcctgggagttggggagctaagtgatctttctagaaggtaatttggcacaggtatcaaaaacccgtaacaaggtgcaactcttcagctcagatgttctactctaagaatgtatcctaaaggaatagacaagtgtctcaggtgtgggtacaagggaattcaccatgccattaaatataatttaaatgaaggacagtctaaatgcccatcaaaaaggggctgataataaagatgactctcttcctgaatggaacaccaatgcagctattaaatggatgcttactaagatgagagctgtccagtcataaactatagtgaaaaggcatgtcacagtactatttagttttttattttataaatacttatgttgcagctgggcgtggtggctcactcctgtaactccaacactttgggagaccaaggcaaaaggattgcttgaggaaaggagtttgagaccagcctgggcaatatagtgagatcccatctctataaaaaaaatttaaaaatcagctgggcatggtggcacgcacctatagtcccagctactcgggaggctgaggcaggagggttgattgagcccaaaagtttgaggctgtagtgaactttgattgccccactgccctccagcctgggtgacagagtgagaccctgtctctaaaaaaaattaataagtaataaataaaaataaagaaatggctatgtttcatgaatataagaatatttaaagtctagaaatatatgcaagttgttttgatacctttcccaggagtggaattacatattattttccttttttattttctgggttgtttttcttgtacagttaaagagttttgggaaataatgaaattaagaattactaagtacataagtaaaagatcataatgttggcattattgagatgaaatgatgtccgctattctccattaaataaaataggtatttggaaacagactgaaatgaagaaaaaaatgtgaaatagcaggttacaaaacagcgtacatagaattatcaatttatgttttattttattatttatttttatttttcatttttgagacagagcttcactcttgtcacccaggctagagtgcaatggcatgatctcggctcactgctacctctgcctcccgggttcaagcgattctcctgcctcagcctcccgagtaactgagattataggtgcccaccaccatgcccagctaatttttgtatttttagtagagacagggtttcaccatgttggcctggctggtctcgaactcctcacctcaggtaatctgcccgccttggcctcccaaagtactgggattacaggcataagccaccgcggtaaaaatgcatctatgtatacagctgtctgtcaagaaatagtctagaatggtattcatttaactgttataatctacctctggaagtgagatgttaaatgcatttatcttttatttcaagagtattttttgacatatgcaattgtaaattgtttctaagcgaatgaaactgagaattgctgtagcactgatagatatgttaatgagcttgactgtggtagtcatttcacaatgtgcccatatatcaaaacattacattgtatatcttaaatatatataatttttatttgtcaattatacttcaatgaatctgaaaaaaagataaattaagatttttaaaaaagtgttctgtgtaacaaatcaatttttttaaattaaagtggaaattaaaatgaaaaaatatttacttaaagaaggaaagataattcaaataccctctggcctgaatcactacataagggactccttccccagagggcaatgtggacatgagctggggtctgagtagctgatttccagtatgacaggaaggcaaagaccagaagcaggtggaaactaccgtcatggtctgacttcttaggagtggcaggcctggtccagaactgtggcctccctcagacctggggaccctaaccatcctgagtatcgaaaagagaaaaagcagaaagggccctagagtttatctagagcaaacacttttttgttcaggtgaggaaactgaggcccagagaagggaaggggtttgcatccaacagatgtaggcttctagagggtgaggactgggttttgcaacagacccagtgcaagcactgcacaggcagatgtttaaagcatatttccaggccacacagtcatgagtggctgaaccaatcacagaactcatgtctcaaagttggactcaaagcccccaaacatggtgccaagagggagcacaggctgtgggatgaaacaggcataaggtcatgcccctctcctgctaaaatctccatcagctcccatctcattcaaaatcaaggttatatctatggctcatgatgtcccacatgctctgtcctccaccatcactctctcccccccgaagccaactctcagaccccacctcctaccatgtgctcactcattcactcggctccagccacactggcttcctggctgttctttgacctctcaggagctttgcacgtgctggtccacacgctgagaacactcttcccatggattcccccaccactccccacctcttgcagagatttgctcaaggacgatcttcttgtgatgacttccctgaccacccatattcaaactgccccttcccaattaccagctcgcctcccccacccttttcctgctttgatctccctctgaagcttatcaaccacccaacacaccatggattacattcacttatccatttcttgccactagaatgtaagcccataagggctgggctttctgtcttttccttgctgtatctccatccttagaatagtgcctggctcatcgtaagctcccaataaatattagtgaatgaatgaaatagaccggatcaatgcccagcactgccttgagcagatcgcttggctccctgttgtgtcatcactgttaaattgagatcacaatgtcataataacaagtgctaacatctggacgtgtaaggtccagccaacctgctctgtctacattatctcattgtctcacacagccagtatggagcagagccagagttcgaagtcaggtgtttgtgactccaaatcccatgatcttaactacactgccataatgcaaaggatactgtagactaaatgcgatttcaacatcaatgtgaagatgctttgtaagtcatgtagggtgaagggctgttattgttttataaggaatttttttgtctgtatggactgttaaccctgcctgcaaccctctcctccttgactgtcatgcagtttgtgctatcttgcttttttgggtctcttctttcaagaggaaagtacctgtgatcctcaacctcaccagatctttagggatttaatgtgctgccctaccctttccatgtctgcatttttttttaaatgaggctgttgaggttaatgtttaagccacagagatgaatggtggaaactcaggcattaggtcatttggagaaaaattcagggatgggaggaaaatggtttgcagcattgaattcttgttcatcatctccttgaatcaagcactgggtcctctatgaatttcaccagtaacttacgcttctgtgctggcgagaaactgcatctccgtgggcacagtgtgtaggccgtttctccgcacagcagctaggaggaaagagcatgatgtctttaatgtaatgtagcgaatggaacaggagtgtcccaaatcttgtgaagtcagtcaagaatgctttctttgccaaggatcctatactactcactgaatcaaaagacaaagacagagagagagaggaagagagggaggaagggagagagaggaagggagagagggggagggagggagggagagagagatggaggaaggaaggaaaggaaaggaaaggaaaggaaagggagggaaagaaagaaagaaagaaagagggaaggaaggaaaggaaggaaggaaggaaaggaaaagaaaggaaaggaaagaaaaggaagggaaaggaaagggagggaaagaaagaaagaaaggaggaaggaaggaaggaaaggaaggaaggaaggaaggaaaaggaaaggaaaaagaaaagaaaggtcattcagcattctatcctcctgtcctaccatccatatgtgaagatgtgcccaggcctgttggcaggggtttagctgcagggctgcttgacaacccataactcaagcttaggcttacctgagcagccattgccaaagttgtgaaaggccagctatgaatggtaatgagtcatcaatgggttggacgaccccaattgtccattcattcattcatccaaaaagtatttattgagcacctactatgtgctattgactatgttctcagggtactctgtgaacaatatagaacaaggcccctggcttccatggaggtcatactctagaaggggaggcaggaaataaatgaataaagaaaattttaggtagggacaaatgtatggaggaaatagaactgggtaatgtgactggaaagtggagaggggagtaggtgggctctcccttcaacagagaagacactgtgtgctgatggcctcgggtctgagacctcaaggataaaatggaatccatcctatgaagagccctgggaaaagggtgcaaggaaacaggaacagcaagtgcaaaggcccggcagtaaggaggtgcttggctgagatgaagaactgaggaagcccatgtgctgggaaagaggtgtataggaaaggcctaggggagatgggggtggggactgactgggcaaaggccaacgggaactaaatcagggaaggggaccccctgcaggatttaatgcccaagacgatatgatttacattttataaacaactctgggcctggtccgagagaatggacgtagggaaaggggcaaaaatggaagctgagagtccagttctggatctgttgcattttccagctaagatgatgatggctggatttggctggtaaccatacagaccctgagagtaataagtggtggatgtgtttcagttcttttgagataagagcttggtgcaacttggaacccagagccaaaactggggcacatgaaccctagccaactgatccctcagcaaatcgctatggagcacctgtcatgtacctggtgctgagtgacaaaagatgaaagtccatgtcctcatggagctgatcttctggtgggggagacagaccacacacgactaagtaatatacgcagtatgtcaaatgaagatgcatgccatgcaaaagaacaaggcagggaaggagccaggcatcctggggtgagacaccttcttcaaggctcaaagaaagtctgatggagaaggaaaatttgactttgaaccaagacctgaaggtgaggggatgagccaagcaaacatctggggcaagaaagagcaggtgcaaaggccctggggtgggagcacacccaggaagcaaaggggaggccagtggagctgcaggggccagagggaggagaagagtaagaggaggcaaggtaagagaagtggcagggggtggaggtggtaggaagtgggtgggatcatgcagggatctcagagctcacaggaaggactgtggcttctcctctgagtcaggtaggaactagagtagcatttgagcagaggaggctcaggacaggagctaactttgtttttaaagttatttctctggtcaagtgtggtggttcatgcctataatcccagctactcaggaggctaaggcaggaggattgcttgagccgagagtttgaaactagcctgagccagatagtgagaccacatctctaaaaaacattctccaaaaaattagctgggtgtggtggtgcatgcctgtagtcccaaccactccagaggctgaggtggaggatctgttgagcccaggagttggaggctgcagtgaggtatgatcatgctactgcactccaccttgggtgacagagaaagaccttgtctcttaaaacaaacacacaaaaataataaagttatttctctgcttgatagaccagactccccagcagcctttgacagtgttttggagaaaagaaaattagaatgaattaaatgttcctgcagctggaaccaccaccaagagtaaaataactcacctctgggagttgggtgtgtggctggtagccaaacacatcagccttgggttcaaatcctagctccatcacttacaatgtgactttaggtcagtagttcccagcgagggccaattctgtacccaagagatgttgggcaatgtctgggggcatttttggttatcacagcttgggtggaagggcaaagtactactggcgtctattagttagagaccagaaatgctgctaaacatcctgcaatacacaggtcagcccaccccagcaaagaattatcccacccaaatgtcattggtaatgaagttgagaaaccctggttagggtatatcccttaatctccctatacctcagttctttaatgataaaatggaagtaaccattctaggattgttaagaggattaaagagttaatctactgccaggtgtggtgactcacgcctgtaatcccagcactttgggaagccgaggtgggcagatcacctgaggtcgggagtttgagaccagcctgaccaacatggagaaaccccgtctccactaaaaatacaaaattagccaggcatggtggcgcatgcctgtaatcccagctactcaggaggctgaggcaggagaattgcttgaacccaggaggtggaggttacggtgagctgagatagcaccattgcacaccactccagcctgggcaacaagagcaaaatttcgtctcaaaaaaaaaaaagagttaacttattaaaagcaaggatcaacaaacttctgtaaaaagccagatagtaaacattttaggttttggggggccatgaggtctctgtcataacaacatctctgccataggggcagaaaatcagccacagacaacatcaatgcttgagtgtggctaaacttttatttgggggacatcaaaaaaatttttgttttgagataggatctcgttctgttgcccaggctggagggcagtggcacgatcacagctcacaacagcctcgacataccaggctcaagtgatcctcccacctcagcctcccaagtagctgggaccacaggcatgtgccaccatgcccagctaattgttgtatttttttttttttttttggtaaaaaagaaggtcttgctatgttgcccaggctggtctctaactctggggctcaagcgatcctctcacctcggcctcccaaagtgctgggattacagaagtgaactaccacgcctgggctgaaatttgaatatcatataatttttcatgtcacaaaatatttttctgcttttgatttatttcaatcacttaaaaatatgaaaactattcttagctcccaggctgtaaaaaaacaagcagtaggctggatgtggagggccatgctttgtcaatcttgatataaagacttcaacagagctgggtagtcccagctcttgagaggctgaggtgggaggattgcttgatctagggaggtcaaggctgcagtgaaccgtgatcatgccactgcactccatcttgggtgacagagcaagacgccatctcaaaaaaaaaaaaaaaagacagaaagaatttaacaggaagctgagtactagcaaatgttcagtaaatatgggttaccatagagaaagaagaaaacagagcatagggaatgattctgacactcagagcctggtcacttcattctccatcatcttgtctaagggcaaggtggctgtgtcaccctcaaaatcccaacatccccctctcttgctaaatgagtgactgctccttccttacccagctcagaattgcctctggtctctctcagtgcccagcctccagtccagatcctgtcctgggttccttttaacacccccttcctgaaataatcagggtagctcatggcatgtgtgccccgccccctcactgctgtagtaaatgataactcagcttgtttcattactagggtattcctggggtctttggtgaaggccattgacactcttcaaggaacccaagcaagacacaaaaaaagtttgattttttttcttttttacatgggattttccttcacatggaagtcaggccacatacacagccatgtggacattccttgtctcgccccgtggtttggggaagtcccttccacaccacgggccgctctcgtggtacaccgttggtaccatgagggaacaggattccatggtggctggctgtgtcatttttcctgtgcctggagctggccctgttgaccccctgcaggggcctgaagatgaaagttgaatcagctgccctgggccatagggatgagggcccctgagcacgagtgctgggaacaggtccacaagccatgcacgaggccagggtccagggcactgaagtaggaagcgagggactattaatagcacactaaggttgggggcaaagttgctccccaggggatggccagacagtaagaactctgacttggtgacccccagtccccaccatcgctagctcgctctaccctcttcccacctgggtgctgtgcaggtgattcctttatgcagccagggtggacagcaacttgtctgaggttacagatagggaaactgagctcaccagtttgccacagccctcgcctggccccgtttgctctgcatctgagttgaagagccctgataagagattgtatgtgctataaataaggcagtgaagggtattcgtacacacagaactctaaacagtaattagctttatcatataagatcaggaaggagggagttttgctttttccttatggagattagtaatgtaagaaaagttaatatcaggcattattttctgatgatgatgatgataaagtcatgaagatgaaactggaaaacctggtgctgagcagagctcttaggcatttacacaggatccacccctgtgcttcctgtgacctcagtggcccaagagaccacatggaaacaggccagtggagcaaagtccccagagagacttctctgggtccagaaattgccagttgattagaagcttgatgcttctgtagggtcttattcacatcatacaaatccttgagtttgtgtcaggccaggggatggagaactttcacatttataatcttacagctgtctccaagcagccttacagagctatgcaaagtttattaccttcctcttcacaactggggaaactgaggcctagagaggtgggctaaattgggatcaagaggacccaatgggtcagtggcagagtcaggattatacccagaactttggatctcccatcccctgaacctcggtccatctccaaggcacccacctgtcactttagcaggtctgacgtgaaactgataactctagtctagcctccctggtatgactaagatgttcttaaaatttgacacgaagagggccctcaggaaagagttcttgtgtcaaattaggtaaacggcaatccagggaaggtcaaaagcccccaagttaagcaggtttatatccatttactcacttagcactcatgtcagcctaagtagtaaggattattatccctgttttaggtttgaggaaactgagacatagaacagttagttcaatggtctatttgtgtattcattaattccacacatttattgaacatctactatgtaccaacagtgtcttaggtgcacaagactgcaccagtgaagattcacaacaatgagaaagactgataggcccttcacggagcttggaacctgtggaggagacagattataaaccaggaagcaaatcaatcccgctcaagtaggaggggaaacaccaaggtggaacgaggtaggaggtcttattacctgtgcctccaatgcctggaagtctcataggtagtttttaatacaactgccatatattaaccacttcctatgtacctggctctcgtttctcacgtaagaggcagtgtccttgttttatagatgaggaaagttgcagaaggttggttagcatatggatgagcaccacgcttcactcaacattaaagacccttgtgttgtgaagggtggcatcctgggccttcctataaaataaagatgtagatggcaagttagctttctatggacagagaaaaggaggggaaagagtttagattcaaaagccaggtggaaggccagatatggtggctcacgcctgtaagcccagtgctttgggaggccgaggctagaggatcacttgagcctgggagtttgaggctgcagcgagctgaatgcaccactgcactccagcctaggagacagaggaagaccctgtctctaaaaaacaaaaacaaaatccaggtgggccccttactggccaaggaacattgggcctatcatggctgtgagcttcagtttcctcatctgtaaaacaggcatgctaatagtgcctccccacagggctgtggtggaggacctaatgagagcgtgcatgcagggggacattggcgaagccatcactcacatggcccctgggtcccccaggaagtgcagggcacagaactgagcaaaggaactggagaaaggcaacagcgctgccctccaagtctgaggacctctggagtcttatccagatagccccaccctgccctaggttctgcctcctctgtaccaggcaccatggcaaggtgcttataagcacagattctggattctgacagagctcagcaaatcatcgtgttactttgggcaaatcattttgcttctctgagcctcagtttcctcatctataaaatgggcatcattacctcctagtacaattatgaagatcagatgagctaatgagtataaaaaaattagcatggtatctgcatgtggtggttactcagaaaatgggagctcagctcacatgatgattatggttgctgctggtgctacagatgtccttcatgaacctatagctcctaggaacttccttgtgcctctcctagcccactggcagaatctctactccctccacccctgtcctcgcctcctgccacctggtcaaagctcagaactggatgaaagggaatagctctctttgtactggaattagccttgttttaggtcttagaagctgatcattaaccaattcctgctcctccctgatcccatggcctgtaaaggtaggtatctatcccaacccccaggatcccctccctcttgacatcctgcagcataggaaaaggctctggacttcaatgcatggccaccactgtgtgtggccttgggcaagtcccttccccttcctgagtctcagatttttcattctcacaatgagggacttggctttcaatcatttgcttgaccactttggaaaaagtctcatgtgggaggcagaataatggagcctgagaatgtaggctctgaagtcagccagcccggattcaaaataccagagccacagtttggaaactgcgtaacggggggtgggaggactctttttaattccttcctcaatttccatttctgtaaatgaggtcgatgcttgctccgtctcattcagatatgaggtccacctaagagtccgcgcataaactaagtgcacagtaaacattggttattattgcttagaggcccagtgtacaaaatgaataaagtgagtctaactagggttgaaatggggaaaagggcagagtcccaggtgcttgctgccaccccagggtgaccatcaggcagttctcttaagggaaacagtttgaaaatcaagaaagccaatattgtacagcaggggtcagtgacctacaatatgcagccccaatccagcccaccgcctgtttttgtgtggcctgccaactaggaatggcttctacattttcaaatggttgaaaaacatctatggaagaatatttcctgatacaaaaattatatgaaattttaatttcagcacccataaatacaatttttttgtcacattgccacgcctgcttgtttgttttatctgtggctgctttctcactgcaagggcagcgttgagtagttgcaacagagtggcccacaaagcctgcagtatttactatttggtcatttatagacaaagtttgttaatccatgctataaagcttctcttcacttcctcgtggaagactctgccgttgcatagagctgactctgccactttgccaatgctatgatcctcaacacatcatctcacctctccaaacttcatctgtaaagtacatataatcatttctagtgttcagggttgctgtgaaaataaaataagcaggaccccttagtgtatgacggggaaatactcatgtgactgtcagtgagattaacttagatggtacacggatcaacatttaagttttaacagatacgtatttaatttaattcatattttaaaaactagaactagcacacaaaacctatggtttcatggataatgcttgttgtgttcactgaggtaaatgatccaaagccacaggggcagatctgccatctatctctcaagatgtggctcctgtctttgggtcccaggtgccatcatattcacattccacccggcaggaaggacagaacccggaagttgcacacatcatttccactcatattccattgaccagactcagttatctgaccaagtcttatcacaaggggagcttgaagtttcagcctttcctcagagaggaaagtattgggttctattcctaaaagaacaaaggaagaatcaatgccggggttaaactagccatttctgcccacatatgtatcaattcaaatcttccttttaaaatacagttatgtaaattaaaagtaagacattttaaagtgacatgatgtggcagccactttgcaaccataagaccaggggaaccagagttgccaatgaaaaatcatgacgtcattgtgcctctgaattgatcctggacttctttaacttcactgtgtaatttgggaaaatcatttccctcttggagactgtatgtagtcacctaaaaatacaatggctgtgtatgttttgttttattaagaacataatttcagaggattgagggaatcaaatccctccgttcataatacgttatcactatttacttcacaaagcctctctttcctataattgattgggtctttttagtcctttctctccccatttcccactctcaccctttccatagcaaccattctgatatgtttaatgtgtagcttttcatcatacattgcttacaaaatcttttgtcgttcatgtgtattttcagcttacatattgaggttgtattctagatctcattctggtttttacctccaatcataactgctctatgagatccatttatagaagtacatggttcactaattcttctctcttttaaaaggagcataatgctcaatggcatgtatccaccatatttgcctttgcctgtactagcaataaagtgcatgtagccaccaacttcccacaccacagagagcgctacagtgaatatcactatgtgcgttccctcctggacctataggagaattcctttggtgtctgggagcaaaactgctgggttacagagtataaacacatttaatgtgattaaatccttgcacaagatccttaagaaactctaacccagtccacactctttctagcagtacacgaaagttcctgtggcccctattcctgtcaacatggggattcatcagcttccttatttctgcctgtctcattgattaaaatgttattgtttcaatttgcatttctctgagtactggtgatgctgagcatctctttgaatgctgtaaaacaaggtttaattatagtacttacttcatagagctgttttgagagttaaggaagataatgtatgtaaagagttcaactcactgctcagtatacagtatgtgcttaataaatgcaaattttaaacaaccaaggtaccatgatttcttatctaattatcagtcattgtcataactaaaacacctgacgcatagtaggtgctcaataagtgtgcatgcccttggccttccctaacatcctttggacatcccattcccacttccaaatcctggtggatttggccccaatcccttagcacagcctcacctgtgttctcttcactctcctggctggggtcctttcgaacctccttctggccaaagagacttttcaggatggcattggcaatgggaagcatcatggcagtggaggcggtgttgctcagccacatggacaagaacgaggtggtcaccatcatccccaggatgagcctgcagagcagatggcattagaggcaaatccagaacccagggcccaggagatcctctggtcccagtttgccatccctgaggaatacaatccatccattttacagatggaaacttgagactcaaagcagaaaccaaatccactcaccaggtttattttagatctaagaaaactgtggttcagtgtgtttaagtgaactgtccataggtacccaggttataaagacatcccaagcctgacgttttctctttcttgccctcaaatcctcaatgatacccatttcagaataaagttgccggggcaccaagacactccactatctttccctcatggccttctcagcttcctccctcttttcccctcctcttaccagctactccctgctgcgactctgctgaacttctcacccgcacccaacacctttactcccctgcctccctgcctttgcttggtccattcccaccaacagaatctaagtatcaggattttttctctttatattgaactctgaatccacctggaatttacttagatgcatagtacaaagtaagatgtaaattttttaatagaagaaaccaattatcccaactctcaccatttattggaaaatccttccttcggatttgggtttcctatagatttattctgtttcaaaaatctgtttccagacttgtgtcttactgttttaattattgtaattttagaatatgtttaagagcagccctactcattattcaaagtcaagctcaaatgtgacctcctccaggaagtttccccctatctccctacctctcatgtgggctctcacaccatgatgtgccccttggagatcaaattccacttggcattggaattagttccatagatggagtctgtcccacaggactggcagctcctccaggaggaggcgcagctacagagcctagcagagcagatggcacagagataatgctagaaacctaggagtcatccagaaccttcttttcctacgccctcccctgtgtcaattttatcacccaaattactctcaaatctatccaatctgttcatctccactgccacctcctagtccaagctgctactgtctcttgtcgggacactctaaatggccttctaactgggatgtatcagcttctcatgcccgtaccctcctgtctgacctctacaaggcagctaagacgaatctttaaaaaatgcaaatctgaaggaaatgagacgtatttgaaataaaatgcaaatctggccatgtcattcctcagcttagaaccctttaaagcacagatttataagtctatggatataattcagaactggattgggagaaaatgtgtatcctcattttgctaacatctaatcaaattaagcatttccttcagggataaacaggcaacaaagttgaggtgtatgagcagtgcctgaggctctgtcacccaaaaaaaaatccctgacattttctctttcttttttttctttctgtcttttcttttctttctttctctctttctctctctctttgctttttttttttttttttttttttgagacagggtctcactgttactgaggttggagtacagtgagtggcgtgatcttggctcactgcaacatccgcctcctgggttcaagcgatccgcccacctcagctttctgagtagctgggatcacaggcatgcgccaccacgcccagtgaattttttgtatttttggtagagacaggggttttaccatgttagccaggctggtcttgaactcctggcctcaagcaatccacctgcctcagcctcccaaagtgctgggattacaggctgggattacactgcgcccggcaagatccctgatatttttatatgacattataatcactgcagacatcttgaaatatcatcgacactcaaaactgctcaacattatgggtgtgattaggcctatcactcggtcttgccgtttgcggtgttaataaaacagtacctacctgtaccagggcacaggtgtctgtgttcaaaaaaaaaaaaattagataattgcattttgctgtagctgttgtttcaaactctgttgtgcattatgcatttaaaaacattattctgggaagatccttaagattcaccaaattgccaaaagggtttatggaacaaaaaataagatgaaaataaaacccctattttaaaggccacccaattctctaagaataaaagtccaaatcctagccagagtgcccgaggctctttaggattgtaaccctgcctccctttcccttcaagcccatcttcccacatcctctgcatccccccaccttcaactcccacctgatcttcatcatctaggcaggtaaatagcaaacaagaatgctaacagccagcattgcctgctcaggtccaggggatttgcctgcatttgctcatctaatcctcactaaactctatgaggtgggtgccactacatcactatttcacaggcagacagaggttaagttatttttcagagcaggtcacctgggattcagccctgagcagtcagggtcaaactgtcagtgtggccccctccaaaactatgggactggaatccctgggggtggggcctgggggtcagcagctcatgttcccaggtgattcttctgcacctttgagaacagctgcccatgatgggcctagtgctgtgtctagcatgcagcaggtgcttgctaaatagtagagaaataaataaataaataaataaataaataaataaataaatggtgggaaccgatgagtttcttggcctggacgagtaaatcaagaagagcaggtataggctccagaggtgtggtccctctgcctctccgctgtagggctggaaccattacctgttcttacctggccggctggactccaacaagcatcaggatcttgagggcgattcgccggtgcaggttccactcctcaatggcgctggccatgatcagcccactgaggaagaggaagttggtgtcgaggaagtactgggggcagaccttgttggagggcaagatgcccatgaaggggaagaggacgatgggcagcagcgccgtcactgagagcggcagggcctccgtgcaccagtacaccgccatgagcaggatgacaaacaagcagcggccttcctgcaggaggagatgcatgctcagagggtcagcggggctcggggcagaaggggaaggaggcccagggctcagggcagagggggaaggaggcctgggctgggggcagagggggaaggaggcctgcggcagggcctgccccggcttgttctcagggcagcagtggagcaggtgtgtgcctaaggcgttgacttaaagcaggtggcatcacctttctaagcctcattttgctcaattataaaatgaggaagctattttggttcacctcataggactgtttgagaatgaaatgaaatacattgttgtcttagagataaagacgagaatgaaaatagtttacttgatagaggatcccaggaggttctggaaggacaatggggaaatgaaacagaaggaagccaatccagagagtgtcccatgagaaggttaccactgtggacacctggatctcaattctgatggggacagggcagaccatgcttcagtgtatgtcccatgagaaggttaccactgtggacacctgaagctcaattctgatggggaaccctgggggacagggcatatcatgccttagagttgtctcaactggaggcaaggaagttggagcatttatctgccaactcctggccatcattggttgagggctgatactgggagcattaactttcagcacttccggcatccttatgtgcagactgagcatgctcctgcagccaggggaaatactcccgcagtccatctcagaggcagtaggaagctactagtgtgtgcggaaatggtgagcaccagtgggggtgtggagttgggacagggagcaactgccacatccttacacggtacttagtgcaatgcccaacacataatgcatactccataaacaataacaacagctgacatctgttgggctattaagtaccaggtgctatttattcctaacaaaatcctagtgatgtaggtatgattattacccccatttgatggattaggaaactgaggtgcaaggaggtggttagcaaggtaatggctgtgcagaccagggtagaccaaagcaatctacctccacagccagaccttcatacaagtgccctgctgctgttctcagctaaatattagacccaatgaaaggcagacaaagtaatttaaatctaatcagtggttgccaaggctagggtggaaggtctatgttgtgggggcataggtaggggttgcagaggagcacagaggaaacttttgggctgatggcaatgttctatacctagattggagtggtagctacattggtgtgcacatttgtcaaaacctgtcaaactacacacctgttctcataatgagagtgataatgacaatgacttcacatctgatgcatccgtgtcccacaggattcataatacttaatgtcctattatttgcatgatcactgttggaatgaaactattcctgccctgcccttgctttcttatgtcctttcaaggcaacgatcttgcatattctaggaaacatgaactttttcttggatttggtcctgtctggagccatcttatggctcttactttatagtaagttttgttaactttattccatgtccataggacatcaaacagcgcaccatcctaagagccaccctcatagaacatatcctcagcgaaacaggacaggtatcaggttacgtgggggatgctatgattagttaatccatcttacagggaggccagggagggaccacggagacccatcagacaactgtgacaacaatccaggcaacagacaccggccaccagggcccattgctggcagttgtaggtagtgagaagtagttgaattctcgatcaatttccaagatcacgtctgacagcttggctgatagatctgttgtgatatgtgaggcaaagagagaaaccaagggcaattccaagttgttggtctcagggaaggtggggttgtcatttactgagatgggggagacacactgtcaccaatttccataccttgaaaaacacatcccgagactctgcttaatacaccctacattggaaaatgtccagattcccaagtcccttagcttttctatcagtgctcacattcattcatgaaatttatagatgtgcaaaaagtctcccgctgggagaatttctgtacagcacatcctattttcctattgacttaagatacattgttttagagaaaaaattaaataagctgccacagttaatacaaagttatccttcaggatacctaaaatttatttcctgggggccagagaagaacaactgcaaaacaaattaactcaacttggaatgaatatcccaagaacccaggttattggacacacacactaaaggttgaaagcaaaaagaataatacagaatcaaactccacaaccaaaaattctctaagttttgatttgtcatcatcctttcagtttctcaaatgaggcagatcctgcatctcagaggtaagatatctttgagaatcacaagaccagagtccataaatacttataacccccagccctttgttcaagcaaaattgtatgttgaatctcagtatataaaacagacaaactttgaatgtaaaaatcagaaaaaaaggcactcttctggagaagtgagaaaaagagctgtcgatgggcttctctgttctctccctcccttccacctatcctggcagcccctaaacctccccgatttggggattcaatggcagatcatcagatcatcaccaagcccctatcatttccctggctctacagatgtggagactgggaccagagaggggaagaatgagtcagcaggtggatgtcagagccgtttccagaaccccaaagctcccccaacaagaagctgagacccttttgttggaaaagcctcaatgtgtgcttggagccaaagggcatcatcccagaattccacagagatagagggcaggcccgtcccaggtatacagcacagcaaacaaggatgtggggaagcagtggcacaataaacagcaccctgtttagagaagctcctggaatcccaacattctgcctacagagctttagtaaccacctggggagccagtgtaccaaaggcttcagacttggccaaggccacctcagccttcttaggctgggaacctgaatatcagctgggaacaatcggtttccacagctcagagagccaaaggggccttcctgaagacatacaactttggagagatggagccacctctcctcttgagtcttggctcctggtacaaaagcagcatgaaactctgtctccagcccattatcctgcttcatgttcttttatgtaaccggttaccacctgaaagcagattttatagctttatatgttttctcctctattagaatgcaagctctaggagagcagggattgtgttcccagtgccaagaacagttcctggcacattgtaggcactcaaaatatctgttgaatgatgaaaacatgtttctacaacttagagaaaaagcttgatccaagctatcattcattcatccatccatttagcaaactttattcctgaccacattttatgccctgggctggaagctggtacaaggaaaatgactaagacatagcctaaatttttaacaagtaaatctggccatgccaaccaataaacagttcttagtcaggtgcctatagtcccaggtacttgggaggcttagggaagatgattgcttgaggccaggagttcaagtccagcctgggcaacacagtgaaacctggtctctaaaaaccaaacaaaaaaaaactacagtgcttctcaaacccaaatcaccttcccaggctctttctgccaaatatccctcaaacaacagatgtgtgttggtaaatgttgaacaattggctctctgaaaaacttgtgtgtgtgtgtgtgtgtgcgtgtgtgtgtgtgtgtgtgtattaaggtctgtatttaataactggctattagaattcctaaaaatttgacaagcacatttcccaagccagcataagctggctgcagcacaccactgtgggcctccaggcagaagaacatccatgtatcaccccctgggccaggaaatctgcatcacattctgcgcaaaactgactttcttccacccatgcttggtatcctgctccacaatgaattcgtgcttttaaaaatatacaattactttctatcaaatcttcctgctgacccaagaaggaatgccccatgtatcctgttctgtgtaccactcaccagaccaacaggtatcccaatttgtaaatatgagtcctcggtggagattatagtctcaaattcccacagaagcccagacataccataaattaactcttggaccccttcagacaatcctcatctttgcgttttgaaaatgatatgactataagatgtttcactttcatcttaggtctattatgagacacctagacccctagactgtagtccacaccgctacttggcattcaaggtttggtgcccagcccatccctggtcctagattcctagactgtagtccacccctctactaggcattcaaggtttggtgcctagcccatccttggttcatatgcttccactgctcaaggagacagacatgaagacaaatcattcacctcccagagagacaagggctaaaacagagtttaagacagtgagctatggagcaaaggtgaaaggcagctgtgtcagccagtggggtctgagaagggcagacacctcagcacctccttgctatggtctcagtgtttctgtccccccagattcatacatggaatcctcatccccattgtagtggtaataagaggcagggactttgggaggtgattaggtcgtgagggctctgccctcactaataggattagtttcctcataaaaagggcctaagagccttccttctgccatgtgaggacacagcaataaggcactgtctttgaagcaaagagcaaggccccaccaggcactgaatctgccagtgccttgatcttgaacttcacagcccccagaactgtaagcaatatatttctattgtttaaatatcacccagtctaaggtattttgttatagtagcccaaatggactaagacagtcctccgtctctcgcttcagtgcccatcattcctgttcacaccagtgacgtcttcagatttctccggtttcagaagcacacttggccaagactgccaagaaataacactccaggagtagctcctagccacgaacttcagttgcctttcagtgggataactgaggcatgtcgaataccatttcccagaagtccccagtaaggctgagtcactgctgctggtagtaacctcttcattggcacacttgtatttcttccatgctcttcactgtttcccttctccactgcccccaaattccttgcagtcaaattgttgtctcagggtccttctgaagacccaatctaagacagaagccttctcagacagggtgacatctttccgagctaggatttgagaggtgtttggcacagagaaggagagggactgccttcttgcctatgctggaagcctcttttgtatttgagtcaaaaaaaggctcatgtcctccagctggatttggggtttatctgagccaaacccagttgagagaggtcccaggcatgatctgatacaatagagtccaagctctgtcattagagcctgagtctttaggtctctcctctccatctgcactgcccttgactaaggtcaaacttcatcagctttcactgagactatttctcaacttttgcacttgtcttcatgaatcctccacataagcagtcaaaggaatacttctaaaatgcacttcagattatgtcactcccctgctcaaacacctcctctggctccccatggcccccagactcacagtcatggcattcaaagcttatcagtgtgtcccagtacaggcttcccacattccccactttctctgttatcttggacacagttctctcagcagtctacgctgcttgtcattctctgggcctttgcacatgcttttccttttgccaggaacattcttctgcttcttcatctagtgaattatgactcatcttgtaaaggccatttttatcctgtgacccccaccctaaagtcctggtcagttccaatatctatgctctcacagcactcggttcacagaagagcagaacagcacagcggttaagaacatgggcttgttgcaagacttcctggatttgaactatagcttgattacaccatgactttcgtgaccttggataggtgacttaatgtccctgtgattcaagtttctgtcatttgcaactcagactcctgactaaaacactcaccttctccatcctcctaacaataaataatacctgacattttaatagaacttaatgtgtgtgctttcatccttgctattgcaaaattcagaatatctctgtcacacagtgatggaaaaaataagaacatttattgaatgttactatgtgcctgggactgttctaagtatgttatgtctatttgttcattaaacaaccttatgaaaggaaggttagtattattttcatttacatttagcaaatgagaaaattgaggcacagagaggttaagacaagggatcttcaaaaagttcatgaaaagtatgtattatttaaaaactatgcatgggtttcaaatttttgcaccaaaataaactcatactaacttattatcacatgtctgaacagaatctagtttgaggcactaaaaaggatagttcgaaaacagcccctatcagagcaacatgaattctgctaaaactgaagcaaaaacaaatatcaaattgatgatgaagtttggatggaagaataatgaaataattgacactttatgaacagtttatggggacaatgctacaaagaaattctagtttacaaatggataatttgttttagaagggatgagactatgttgaagatgaggcctgcagtggcagagcatccacatggatctgcaaggaaaaaaaaattcatcttgttcatgccctaattgaaaaggaccaacaattaacagcagaaacaatagccaacaccacagacatctcaactggttcagcatacacaattctgactggaaaattaaagctgggcaaactttccacttgatgggtaccaagaccactgcaccgagatcagctgtagacaagagcagaactgtcaatggaaattttaaacaaatgggatcaagatcctgaagcatttcttctaagaattgtaacaggagatgaaacatggctttgccagtacaatcctgaagacaaagcacaatcaaggcaatggccatcaagagttggaagtggtccggtcaaagcaaaagtgaactggtcaatagcaaaggtcatggcaacatttttggggggatgctcaaggcattttcctaattgactttctggagggccaaagaacaataacatctgctcattatgagagttttatgagggttagccaaagctttagcagaaaaatgctagggaaagcttccccagagagtccttcaccacagcaatgctcctgctccttcctctcatcaaacaaggacagttttgtgagagttttaatggggaatcattaggcatctgtcttatggtcctgatatggtttcttctgacttctttttgttcctaatctttaaaaatctttaaagagcacccatttttcttcagttaataatgtaaaacaaagatggcattgacatgattaagttccgcagactcttagtttcttaaggatggattaaatagctggtatcatcattacaaaagtgtctataacttgatggagcttatgttgagaaacaaagtttgtatttttatttttgtcttttaattccattttttcatgaactttttgaagtcctctcatcttatagatggttctggaataaaaaaaagttgtggctccaaatccagaaaaatacactgagtacattctgcacggacagaataactggcagctgagtcagctgctaggggcaacccaggaggtcttaagcaatctctgtgtggaacttcccggcacatcacatccaatgtcacatgatatcttcccaagaaatggttctaaaatcaaataagtttttcaggaactgttctccctaccgctccgctaaaaattcataattggtacactgaaagtgctaacaaatcatgtagtacatatatttatttgaccttatctaacccaaagtttccaaaatacgtttgaccacggattgaaatatttcttaaaatcctccacaacttatgctccatggaaaatagggtggtaaatggtgccaaattgtaacctgcaaaggttcatccattcaaaatgatttactgactctgtctcctcgactactaagaaagttccctgagaagacggaccccattgcttttatcttgttcacgtctgtgtccccagaacttggcacagtccccaacacattgatggagttggtttcagggagtgtggaatgagtgaaagaataaatagattgtgaccctgactctttgctggccaccatgctggaagttcaggaggtagagatgagtaagtgaacatctgcccttgaggatctcagagtctagggatcaagcaggtggatgccggctcaaataactacaatgggatcaacatgtggttctcagtaagctagggacacctaggggaaagtaattaacttaactcagaggacaaagaaagatagcagggaacagttttcttaggaagagctatttaaactaaatctcagacaataaaagcttttgcagattcctaaggtcagagcctcccctttgtccagcaggcacttgagcatttatttgcctattgtactttaaaatatgagggcagatttctggagcagtaggggattcttgcaaatttgctcctctaactcaacaggaattggtgtgtggtgtgtgcgtgtgtgtgtgtgtgtgtgtgtgtgtgtgtgtgtgtgtgtgtgtgtgtctgatactcatgaatagcaacaaagttacaaatttaagaaggcaatatagcttccctgctagggacactctaaggtcagaacttaatagatgacaagaattttaaaaagacatgactcagatcttacaatatcaaagggatacaaagggatagtttgaacaactttttaccaataactttgatgatttcaagtaaccagaggaacttcctgataaaaacatacctttctcaactatcagaaaaagaaattaaaaagttgaatatttcagtgtctattgaagaaactgaatcaatcattaaaaacctccccacgaaaaagctccaagcccttctggcttcaatggtaattctaccaaacattgaaggaataaataataccatcttgcacaaactctttcagagagcagagaaaaagggaacacttcccaattcattttatgaggacaggataaccctgttacctgggtgatcctgacaagggcattaaaagaaaagaaaatggaatacaatggttgagaacagtgacatgcagtcacctggaaaatttcaattctcaggagctctggtgagagtttccttttctatgcagcttcacatctctatgcagaagaataactacagtataatgacaatcacaatcaccaacattttttgagtattctctaagtttcaggcgtcttctatgtattaactcatgtaatgcccctaacaatcttttcttttcctttcctctctatctttttttgaaccaaggtctaactatgttgcccaggctggtcttgaattcctgggctcaagtgaacctcccatctcagcctcccaagtagctgggatgacaggcatacactgacacacctggattcaggaaggtactattactttccccctctgttttgggggaaattataaaaagatgtctatttaggtcatgcatacaatgctgtgtcccaggtaattcagtcccagggtagtgttgcagcttacaaactgtgtagtctaaacaggaattctaatttttaaactcttctcttttaaacatttaagggactcaaagtataacgatcgctagcaattaattagcaagcaattaatttccaagtaattgcatttgtgaactcattttattttcaaaacaatcctttgaggcagatattattagctctattttactgatgggacatggaggcaaacaggaaaagtcaagtaacttgcccatagctgctgaggcagtcaggatttgaacccaggtggtctgaccagagttttctctttatcactatgtatttctgcacaatccgtgggtgttcttgtcaaatgcctacatcctctctattctctagcatgcctgaaaatctctctcgttcctaggccaagagaacctctctcaagcttcctggctccttgccatctctgcccctccatgactccccatctctgcctcactgtctcccacaaggcatgctaataataaccatcctgttccttgccaattcctcattcacaggaaccccatccttctagttctggctcctttctccagaaaataacctatctggaggctctagttcttcctctcttcatgcaatagcaacaacaatcactatcaccataataatactaataacagtcaatacctattgagaatttgctatgtggcagacactgcccaaacaactgtacctgtgtattatctcagtttaattgtgattgtcacaacagccctatgcaggaggttccatgattatctccatttagcagataatgcaactgaagcacagagtgaataagtagcctgaccagggtcacagagatgaaagtagtggacagcctgctgggtagacacaaggcaagctgctcatagcattatgctattacacaagggggagatggagagagctagacaagctattcccaaatatccaatcagtattaggatggatagcagcaaaattgtttagcataagtatatcccatgcactatttgggatatacttatagtttaaaaatgactccttgttcatctgaaattcaaagtgaacttagcaccctgtgttttatccctcaaccctagctggaccaacattccaaagatgtgaggagggaaagcccaagtatttctaaagaccagatgtggttctgaagtgagaatttcagcccaggtcctctttaaaatcctgcctaagaggtctgcttctaagtgatataggacccctaagggagttcccatatataggaaaccaggaactagagggggagcagccaggggaaaaaaaacccaagggaagggctgtgaagtgttctgagaagggggagatcctctagtctcccgactctgtaatgctcacaagagaagggtctgctgtaaagggaagctgaggggcaggagtcatgcacctgctaggctccttgtcttttcctgccccctggcttctttcactgtggctgtcacaaaccttgcttaagaaaataaggaagaagagatgaaaccgtaaaggggaactcaggagacaataatctctctttcctctttctctcccagcttccagcctgtagagccctcaggaaggggaggggaaaggatttcacttcaaatcaagttccacattctgatgatcacctggaactgaccattctaatttctgaattgagaccatgtttgtgtattaaagtaattggaggattttaattacatctcaagagtgataggaaaaggcatgtgtctgcaggggtttttgtccaagtaataggaaaagaacttccccactgaaaatattttagagcactagctggagagaaaaataaacatgacttttaaaaaatagctcattgagctataatttacataaaataaaagttctgacaaatggtcatattcatatagccaccatcccaaccaagatataggacatttacatctccccagaaagttcctacatgcccctttcaggtcaattcccacatcctctccaaaacagtgctgcaatttctatcactatagattggtttttgcctgttctgggatataatggaatcatacaggatgtacttctgtctctggctgtcttttaattttaattttaccaacaagaatgagcttgaagtgtgtctggctgttttgctcagcgtgatgtctgtgagattcctccacgcagttgtgtgtatcagtagcctattcttttttgctgctgagtagtattccattctgtgaatagatgagaatttatttgtacattttcctgctggtggacatttgtattatttccagtttggggctactatggaaaaagttgttgtgaacactagaatacatctgctttggaggtgacatcctgtgagtccttttgtgcgatgtattcattctgtacatgatataaatggtaggaaagttgtttaaattctggctgcaaaggttgctgtcaaagctgtattctctctctctctctctctctctctgtctctctctctctctgtctctctgtctctctctccccccttctttttctctcctctccctccctccttcttcccactccctctgtctgtcctctctctccctccccctccttttctctttccttcctctctctcctccctttctctctctccctcctcctccctttctctctctcctcctccctctctcttcttcctctctcactccccctccctttctctccctccctctttctcctgtctctctggatgctcctgtcaggatgtcaactcagctttctgtgaaggaatgactccagatacagcacatgtcagctggagaggtgacccaagggaaatggcaggagttgggaagtcaatccttggcccacttggggttttggcagcaagtaggtcaagagtgtgttttattaccttgctggagagggactggagcagagccagagtgacccccaaatgcctgccctgcctcagctgagcttcctgtgggcaaatggattcagatttgccagctgtatgccagacatctggtggagaattagtaagaagtgctgctgcccctcatcccctgaccttcccactctgccaggacttaagaacaaaactaacttccagagagcaaaaatctcccaggggacttggaggcagggactagagcactgaggcctgtaaaatgctaagtggtgggctctcagaacaagcaggccaggccttttcccccgtccaggtctttgcacctgctgttccctctgcctggccctcttgaccccacgcacccccttctatctctggctggctggctccttgctgttcagccctcacttcaaaggtctcccctccaggaagtccatctctgatcacactgttcattgtggtctgctgcacattatctggcttcattcttgtggagccacttatcactagctgaagtttattttttgttcattcacttattatctctctctcgcctccctgcagaccaggagcaccatgcaaacagggccttttctgtctttgttcgcctctattctcagtgcctcaacaggtatttgttaaaagaatgaataaatgatataaagtcatttcaggcatttcaaactcatatgcaggggacaatttaatgagtaatatgggctggtgtaagaaaagtcacgttttctcaagtctgatttgcacttccaatagtgctgtggatatagaaaactattattttagcaggggataaaagttcccaagcttaacagtaacttacagctggcactggacttcagtgtcatgagtgcaatagggaggggcggggactgtggtgaagtggggaacacaggggcctcccctaccacgaggacaaccactgctgctcagctcctctgattgttgtgatgcaggaatgtgggtcccgtgatgccagctctcctgatttcaagagaagcttgaaattttgcttctatgtgaaatctcagttttaaaagatttgctcattaaaaggaaactgtgggccaatcaaaaaaaaaactacatctgcaggtggtattcaacctatagtcaccaatttatgacctctcatctaagtgatttgaattggtagaaggatggacccctgcggtaattaatgaaaaaccgacatattgtatatgtgcccacacatacgcaatactgaatgtaatgtcaagatgttgacagattagtagggatcaccggactctgtactgaaaacccctgctccattttaaaatccccattttacagatataaactgaggtctggagaggaggtgtagtgtcttcaggaccatgcagagcctaagagtagatctcatcactcccagccctggtccgtttgaaatagtggaatcatagaggggagtccaggtggatccatgattttactccacccaacagcagctctggtcaacctctgcctctgggcctcctgtttcatgaactcacaccagccacgtggccacactgaggttcattctgtgtgtttgcaaaatagaggcttccctcggatcttcaagggcagattcaggtaggaaggagtgtggggccacatgatcccgaggcactgctcctttcaattttaacttctggagttcagaggttgggagaggtgtctgattttgcagacttattttctgggtcaagccagggtgagcagtttgctttcttgccacttgtttctgtccagaggctccattttgggagggagaatcttgctgagcgggcccagggaagaaggagtagcagcttcgggtaaaacattgcttagctcccagcctactccctctgccgtcagaagccagtgggactcagctaaaatctctagggttgaaggaactgacggcaaggcctaacggagtctgcatctggagaagacaggtgccacagggaaggaggctagtcctaatgatcaaggctgaccctagaggccagattctgggtgaacttgatatggatgaggttgggaggatggctgaaatggaaagtggtcagctgcctttgaaggggaaagaataccaagcaactctctagtgctggcctgtctaaacagtggagccctgggtcacatgtggaatttaagttcaagttcattaacatcaaacaaaatttaaaattccagtttcttagtaacactagccacatttcaggtgctcaacagccacatgggactagggtccaccattctgaacagagcagatatggaacatctccatcatcacagaaagttttataggacagactgttctagagaactcaggcccaagggccaggaagcctggggataggtggttttgctgctgaatttttgcagaaaatcactgaacacactgagcctaaattagttcatcttctaattgggaataataatattgggatgtctacatcacagaggattccattaggacaaatgtctgtgaaagcattttgaagtgtgtgattgacatttctatcttagggatgatattatgaataaatttggatttctttcttatatgctctattttccaaacttcaacaacaaatatgcacatattttaaaaaagaaggcatcctctgaatacacaagtgatatatctgtaaaattattgggttacatgttctttctctgagaattagcagatatttaattattgcagaaatttgagtccagcctgatttctcccaccccttatagctcacttgaattttttgcctggatatccataaggttttttaattaagcttcaagtccattaatgttaccacaatttgtcttggtgttgatgagtgtccataagctgtttctggaagacagtaagctctttcaacctgcatatgttttagttttggagaaatgttcttctattaaagattccaatattgttttccattttatttttttcttcaggaacaccaattatgctgatgttggatttcctttgtcttccatactaattgtttttcatccatcctttcttacttttccacttcattttgttcaatcttttttagcctgtatatcatgtctctgattatgtttttaatatttccccattttgctctgtctgatacagcctttataacagaatagctttatttttctcttccacttacttcctgagtgctgttttttcacccccttctgcttcttaatctctcttctttgccctttttgtttcttattttgagatttgttgtaggcaggcaatttttaaaatacatttcaccgaaaaatatctgtccgatagtttctcccacttcataacacaaatcttctagtatttattctgtttttctcctttctattttatgtttcttccctttttatttctcatgctctctttttggcagatctcatgttggctacttattacagaattgcggtcattcttttaagaccggttctttgttggaggaaagtgtggggaaaggggctggcccacaggtatctaagcattggctctgttgactatctcagaatgctttctcatcaacatggacccagaacatgcctctcctctaagcaagggggagccccttactcaatgcgaagacccaagacggtcacagttctttggtgtctctttagcatttatgtttgtttgactgacagagagagaaaactagaacctttacagccatacaggtgatcactatccacaatctctctcccatgtgccattccaacatcccgcttcatgacaagcgtcttggagcctcctcaatcagttcatctgaatgctgtactgtcacatacatctcaggaactctcccttctctgacatgcatgctccaggctttgccagtattaggaagtgtcagagttcaaaaacacttcagaactcctcgtcctgcccacgatgtgcagaagcatgcgccactcttgatttccttctgcagtttggtcaaagtttcctgccattgtcagctcttcttcatatgctggcgaggtgggattgtggtctttccttctttcatcaaagatggcatattcttctccttttgttgcttttgtggttgttttcagagtgcttcagaaaggtgaatggaataaaagtctttgttctactaacttaaaccataagtgcctcccacctagtaattctgtgatcagaaagtgctgttttcttttgcatatctgtattttctaatctttctacaacaaatatgcacagttgaaacaatatgggatttggaattaaaggagcctgaattaaagacccgattcttccacattctagctgttgaacctgggcttgttaactctgtttaccttcagtttccttgtgtgctgtagacatatgatcataccatctcccttggagagatggttattaatataaggtaaccactgacccagtgattgatacatacagtagctcaatacatatgatatattgttatgttgtattaaataacattgttattaatagtacaattagatcaatttcataaagctgggcttcaaaaatactgtacttaaaatatgagagtcagaatgaagctgagatcatttaatccagtggttctcgacagggggtgattctgtcccccaggggacacgttttagtctcacgactggtggagggtgctcctggcatctagtgagtacaggacagagatgctgctaaacatcctgcagtgtccagaacagccccctacaataaagaattatttgttccaatagggtcaatgtccacagtgctgaacaaagtggagaaaccctggtctaatctaacttttagtacatacaatggaggaagtggttgtcccaagaaggaaagtggcttccctgaggtcacacagtgagtcagaggtagattgtgcaagttaaggccatgctttctcttagttcattgaaagaccattgtgccctgggctttatcatgcagcaggagttgggagcagggctgccatgtgggcgaggctcacgcgtgaccctgagtgagctcctccttcaatcttgctctccaaatgcctcatgtggccaccctagtcctagccttggtccccaactcagccccgctcacacccacccaacccatacataatctccaaggtctggctttcttataggaagccttataatccccccaccaaagaaatcccagcttctcaggcttagccaatacacgaccacagggattaaagcctgcaagcaaaacgcgcaggggtgagagacgggtggagagagagagaaaaaaatgccatgtcaggtggttaatttttgagctggggaatgatttccaggcatacacaaggcaacttttttcctactgccccccaacttgccctctttgtgtaggaaaggaaagaaagagaagtggtctgttctccaggaccctggggcaggaattttcaggacactgcctccaccaccactgtccccttccccctgccccagctccctgctgggctgcagctggcatttttgtcagggcactgggcagtgaccaggctcttggcagatactggtagctctgtgccaggcagagagctggctggcccacactttggggacaggactgagaccagctgcccacagcagtgccctcctgctgcctacgagagtcccacttctcaggagtgtccagggctggggctatgaagtgctgaactttgcactccagcaaggcagaagcaagccttaaacctcatggtatcccgttgcccaggactgagcctgcgaagtgccagaccctctggagctacatagtgtttgaagcatcatggctcaggcactcaggactggtgtcgcttcctcactccgagcgtcagttcactcatggataacatgggaatgacggcctcacagaatcaccatggtgggacattgcctggaagaaggccagcccccaagggggaaaaaaaaaaaaagctgccaggatcaggggaaagagccatggacagggagctgggacctgggggttataatccggacctgatgccaagaagcagagaagcctatgggttatgagcttggcatccagtgccagattgtctgggttccaatcctggaagtctatagcttccagagcagatgacttaactttgttccttggttttctgtaaaatgagggtgatgataataatgatgataagaatttcaacctcatagagttattgttggaaggattaaataagttcacgtaggtaaaaggctgggtgcaacatatagcccagagtaatctctatctctctctctctctttcttcctctcactctctctctcccttccttcctctctccttttctctctttcaatagatagatagatagatagatagatagatagatagatagatagatatatctatctatctatctatctatctatctatctatctatctatctatctatctatctgtttatgtatctatcatctatctatctatcatctatctatctggagatttacatatttaatgttacctactactggcagctgttattttgttacattccttgccctctttatgttagaaggttcatcccaatgatccataagctacttcacgtccaccatttggggatgaaggtaacaattccagttcccacatatatacggaccccaaagggaaagaaatttggagcacacagagcaggcccagggaaaggacccaacctggaaagaagagacagaacccaagagaaaccctttctgccaaggccaagaagcacattggcatgagacctccacttggaaagaggaggttaaatcaggcaggtgaaggctcaggggaacaaggccactaggagtcacatagcttgggtgcaaatctcagctccaccacttataagccaccagcttcaggctgactcattggctttttggagcctccctgtctccatccgtaatttcggatgcatattaggccatcctcagagaatgcccaggggagatcaaaaggcaggtggacatggctatgctttgacagtcctgcaatatgggcatttctcccccagcctctggggcaactctccctcatggcctcagtgccataccactgctatctgagatagctacacatgttgagcccttactacacaccagacactgtttggcaattcccttgttaaactctacccactgccctgagaggcagcaataactactgtttatgggtggcttggtttattgtagctcagagaactcaagtgacttgctcaaggccctctgcctcaatgcaaaccatagacaagaagaacaaagcaactatcgattgagggcttactatgcttaggcaccaagccatgctttttggggtgcattagctcgcctgtgtgtcccagtgaccctgtttagaaatgataaagcacacagaggtttggcaacttctctgcccatgtgtgtacatctagcaagggatggagccacgatcctaccatggtggtctagcccagggccctagtcctgatcttatgggccctatccccacggctcagcgatgaagattatagtggagggagcagccagcatttactgagcacttactatgtgtgagtgctgattaaagccctttacagtaattgtgtcttcagctcttcccaggctctggtaggttctagtagaggaaatgaaaggacaggcactcaacagaaggtgcttgataggcattttcatatcctctctggggggctaattcagtcttgagggtgagcagaactgattttcgtgtgcccactttccagagggagagactgaggcatggaggattaatccagaggtgatgcagatggaagtagttgaggccaccgggaagtcttgcttctggttgccaaccgaggctccctcttaccttgtcccatgccccaaaacactctgagacagcagctaggggccatctgtgtccatctgggcacaagactcaatgggggaaacagaaagggcagcaaacctgccccaggagatgcctgagccccgcccccaacccctcccctacagtggactctgttagacccctggactcattagtggatgttgtgacaagttcaagttcttggagccattcattaaaaacgttcctgcggtggctcacaccctgtggctgcccaggcctcactaatcattcacgagccagacaggagggtggttgtgggggtgtgccctggatgcaggagctcctggtggcctcactcagcctgaggagggtagaacacgttgttctgagaaaataagctgattcatggtgtgaccttgggcagctccgtcctctctctttgcctcagtcttcccaactgtccagctggttccttcatctcccatcatggagcggcatggtggggtgcaccaaaagctcccctcaggccccctctatgtcccttttcccctgtcatcctctcccgcacctttgcagctggtgctaatgggaggcctttctccaggtgaagtgaaaccctgcccgaaggcactggggtgggacgagcctttaaatcccatctgggctcttcattttagtttttctgtgaccaggggaccaaggatcagtctcctggaaaaggctgttatgagaaccaaggaagaccacttgctgtttcttggacacttgccatgctcccacccttctttatgttagaacgttattcccaatgatctgtaaaccactttgggtctatcatttggagataaaggtaatgattccaggtaccacatatatatgggacccaaagggaaaggaatttgaagcacacacggcaggcccagggaaaggacccagcctggttagatgagagagaacccaagagaaaccctctaccgaggccaagaagcacagccgcgtccatgcaaagtgacttttgcacttgctgttccctatgcctggaatgctcttcctttatagatgctcagggcttgctccttcaccttcttcaggtctttgctcaaatgtcacctccttttggtatgtgttcaatgctcccttttccaggacaccttccggactctacaattgcactactctcatccccaactccctccctaccctgcttttgttctccatagcagttatcatcatgggacctactgtcagaggcgtttgaaccagagtgactccatcttgaacaggagctggggagaatgaggctgagacctgctgggctgcattcccaggaagttaggcagcctaagtcacagaatgagataggaggtcagcaggactggtttcacaagatacaggtcacaaagatccaattcatgaaacaggatgcagcaaagaagctggccaaaaccaagatggcaaggaaagcgacctctagttgtcctcactgctcattatatgctaattctaatgcattagcatgctaaaagacactcccaccagcaccatgacagcttatcaatgccgtggcagcatccagaagttaccctatatggtctaaaaaggggaggaaccctcagtttcaggaacttcccacccatttcccagaaaactcatgaataatccaccccttgtttagcagatgatcgagaaataaccacaagtatgctcagttgagcagcctatgccactgctctgcctgtggagtagccattcttttgttttttcacttctctcataaattcactttactctgtggactcaccccgaatccttacttgcacaagatccaaggaccctttcttggggtctgcactgggacccctttctgccaacaatactatagatcttgcttatttatccctcgctagaatgtcagctgcatagctgaaaggatttgtgactgtccggttcactgtgactgtctgccatgtccccctagaatagtagctggtacctagaaggtactcaattgaaattttttgactgattgtattagtcacttgtgggtagcacctggcacacagggaacactgaggaaatatcccttttgattccataatcattcaggacacgtggattaagcacctgttgtgcattggtggacaagatggacaaggtccctattaacctctcactatttggagggcacttttttgttttacaaagcacctggttcccctggctcctcatcacagccccatgaggctggtgggcctgtaggacagatgagaaaaccgaggctggcaagggaagtgcctggctttcacctgcagggaagttcttggccaatcttggctctgtcctggatcatccgagcccacattctgtgctcccactgcttcttgggccctgggctctggcccacccttgacattttttttttctttttttcttttttttttgagacagactctgtcacccaggctggagtgcactggcgtgatctcagctcactgcagcctccgcctcctgggttccagtgattctcctgccttagtctcctgagtagctgggattataggcgcccaccaccacgcctggctaatttttgtatttttagtagagatgggatttcaccatgttgaccaggttggtctcgatctcctgaccttgtgatctgcccacctcagcctcccaaagtgctaggattacaggcgtgagccaccgcgcccggcctgacattttcaattctcttatgtttaccatcatcccagctccacctgggtccagctggtcctgccccaggcatcctgggagggggcgcagttgggaaaccagtgagtgaaggggaagctggtcctgggggaagccggccctgctggaaaggcccggcctgtttccaagccccttttgacaatgcgcctccactgctcacagtccctcgcttctcaggcatctgggacttcgggattttggccaagaataagaatgacaagggaactctcactgagatttttctctgaataagcatcatctcagttaatcttcccagcagcccctaggagatgagctttattccattttatacaggaggaaatggaggctcagagaacccaagaacccacacagtgagtaaagggaggaggtcaagaggattcaagaacaaacctcatcccctataatgcccttccagaccccagggccaagaggtcatttgtaaggcaaacaataccactacgactactactgacaatagcaaacattgacctagcacctgttctgggccagatacacccctaagtactctgggcatgtgaacccatcatcacaacattcctatgagttaggcccgatcagtattttcattttacagaggaggagactgaggcacagagaggctaagtaacttgcccaaggtcacacagctaggaagtgggagagcaaagctggagtccaggaaggctggtgctagggttcatgctctcatggtgctgtccctcctcctccatcccccaggaggtgattcagggggacataccaccccaggtgaggcaggctccttctctaggaagggaaagccagggtctggagaagtacaggttccatatcaagaaaaaagtcaggagcaggaagcggttgatgtctggtttagtgggggtgagaatgtcctctcagaacaggcctcagtctcccctatcaaccccaaagaaaggtgagagccaggccttggcaggactccccaggcctggatgtcccacgattctggtcccagacactggcagagcaggactggctgcccagtgaggagcccatacctgcggctgggcactctgtggtgtaaaacgcccaactcaggcaccatgagaagttttgctgactggttccagccctttccagagaattctgagcggggccacaggctggggcagggattggttaataaaaagagctggaagaatgttcctttgctctgcccctcacccctaggcccccagagccagcactttcagcttgtcaagagagaaaggtgcaggaggcatggtaaaacccaggagagaagcggggccgtgggcggcggcgaacaagggcctcttttgttatttccctagcaagggaaaggcggctgtcctgactgctgcggacagaggggccgtcagctccgtccagtgaagcctggagctggcctctgagaggccctgagggcaggagtgcctttctcgtgcctggaatgccctgcatttccaaatcctctccttcctgccaggccctctgcctccaggctgtgtgctcacaggctagcatgcccctctttaggcctcagtttcctcatcagcaaaatgggactctggaccatgcctgcctccacgtgtcagagagatcaaaggaactaatgcatttggggcagcggttctcagccttggcaccgcggacatttggggcctgaggattctctgtggggggctgtcctgtgcatgggagggtgtttagcagcatcgctggcctctacccatcagatgccagtagcaccctactcccactgtgagaatcaaaattgcctccagacattgccacatgtctcctgggagcaaatttgctggaagactcactgatttaaagcatatcctctaaggcctgcgacacagtaggtgctttgtccctgaaggtagccaatgtttttttagctctctacaaacatcatctattattatcatacccatttcacagatgaagaaactgaagcacgaagaggttaagtaactggcccaaggtcacacagttggttaaaaagccaggactggggccaggcatggtggctcacgcctgtaatcctagcactttgggaggttaagggcaggggggtgggggtgaggggcagatcacctgaggtcaagagttcgagaccagactggccaacatggtgaaaccccgtttctactaaaaatacaaaaattagcctggcgtggtggcaggtgcctgtaatcccagctactcgggaggctgaggcagaattgcttaaacctgggaggcggaggttgcagtgagctgagatcgtgccactgcactccagcctgggcaacagagtgagactctgtctcagaaaaaaaccaaaaaaacaaaaaaacaaaaaaccagagttggaaccaagcagccgaacccaagctcctccctccactgcctgatcacttgtgttagttcttgtctccataaactccaatcttcagaaagccctctgagatttccaaactcccactccagtgtctggatgacatcactgtcctctgggaagcctgtcttgatgtcccaccttccccatccagcacaatcgctcccttccctgatggcctccactgaaccacaaaagagtttgggtttccaatgaggcagacctaggctcaagtgccaaccccactattttgtcaatggctatgagatgctgggcaaatggcttaatctctctgagcctcaacttcctcatctgtaaaatgggtccatcacctctgggtcatactgcatggctgagaacacagaccctggagccagaatggtgaggtttgaatcttacctcggccacttcccagctgtgggagcttgggcaagtgagggaaccactcggtgcctcagtttcttcgtctgcaaatgtcagtaataacacaccagcccacagagccacagtgaacataaaaaagctcacaagcatatcatgagtgcttagaaccatgcctggcacttagtagatgctagaggtgctggctgtggctcttttgaagtctcctcgggggacagaggagagtgcaagaataaggcatgtgatgtggcccaggacatcaacaaagctgaggtcacttcctacagcctcccaggtgtcggcactttcttgtaggggagctgagtacagtggaaatcgaagtcctctctctgcgcagagggctggtaaggtcctgcaggagagtagagctaaaagggtggggaagggacttcaccaggttgaccggcagggcaggggcttgctggcctccccggctctgctccaatgtctttttctagctggggctcactgttgtgttctgcctatgggtgctcctaccagcaccacaggcaccttcccatggctgtccctcttcgtgtgaatttcaaggacaaacaaaaagagcagagagtctggactctctgcagataatagcaacagcagcaatcctttattaagcacctactgcgtgtcagcacctttgagccttcccagcaggtatcattatgcccactttgcagatgaataaattgaggctcaggggagggaaatcacttgccgggaagtggtgtgacctcatgtggctcttcccaagtccccagtgcatctcagctgaaaaaagcagtttggacacacgtgtctgacttgttccaggcccgggccaggtctgcccctagctagggtgctgacttcgtgtcttcaaggtctggcggtgtcagagaattctgctcatcagtccagagagcactgtcctgttgagttgggtcaggaaacacgatcttgctccctgctgcatcactggaagtcacgccagcctgtttacacacctggcaggagctccgggaaagtggaaagttggctggacctcagaggaattgttctggggtcagcgggtctatgtgcccacttgagggatggggcaatgggtcaaaccgggtagggagagcatggaggggcacagatgagggatctgggtccactaggctgggagaggttagcaaagtctctccagtccccttctgggcctcagtcttcccagctcaaaatagaaagggctggaaaccctgattcctgctcaaacgttacgcaaaccaggaagcagtctggggttttagaccccgtacaggttctgaaatcagaacttgtgttcaaatccaaattcatggaatgaatactttttcactgagcacctactatgtgtcaggcactactctgggtacagggctgccatagagcacactataagcataaacctgctcttaggtcactcacagccaagggggagaggcagacactagacaaagaaatgatcatttcagatcaggatgaatgccatgaaggaataaaacagaaggctgttttagagagtgatttgtgggatgaagagggcaggtgtgcttgagaagcaggaggacttctaggaggaggtaccattggagccaaggcctaaatgaccagaagcacccagctgtggaagatctggggcaagaatggtccagggaagcaagtgcaaagggcctgaggcaggagcaagcttggcagctttgaagaaccaaaagaaggcacatgaggctggggcacagtgagaaaagacaagggcaggggaagttgtaaaatcaggttttctaatttctgtatttgaggctctgagaccctggagggactgccccttcccagggctagcaaattcctagaaagaataaactactagcctgcaagcattccttcatatgtgaaacaaccaatcgagaccccatactccctaccacctctttttgagggatctcacatgaatccacctgccctaatcaccccagagccaggtacaagacaactaggggaagcccctatgcccccagacccactgaaatgattcaaactaactagccagtcctaaacctgcacaccctgccttgcccgaacatattgcccacagtaaaggctcatgcccacgtttcctcttattccctctgcctcccgacagaccctgctgctcccctgtgtggccctgtgtggcatggtatgcctcctgcttctagggccatctgagtataaaaacttctttgataatgctgatttctgtgtctgtgtgtttatcatacccaaataaaacaaattccattaccattaaaacagacacaaggggacaggtgggcaggagctggatgacacagggccctggggccacagctgtgagcatgggtgtcattttaaattctactcaccagctggggaccttgggctacaacactgcactgtgctgaccctcggtgcctcctcataggcctcccttgtctggatgttctaagcattggctgcaatgcatgtgaagtacccagcataacacctggcgcttagtaggtgctcagtctatggttgcttttgccagtttctgccctcctgggtcgctgtgcactggaagtctgcatctagagttgggaagatgactccttgccctctccccctgctcaggactcttcctgctcctggcctcttgcgcttcccattccccaggagcacccttccttcctctcttcatcttaccacatccagtccaagcgcaaagccaaccagagacaagaagccttcccagcttgtcagcctgaccccagagctttacggtgagtcacagcctgtccctgtccctggattgccaacctggctctcgaattagcctctgattattcccggagtgtccagggtcagcaactttctgcaggaggcaaagggccaggggagataggcgacagcaggagtctggaagtcagcctgagaaccatctgccgccatctgccgccatctgccagcctaatgtgggcaggggtctcctcctgtctgcacgtgggctcttcattgggcaaatggagagaatcgtagtagctccttcttggggtcatggtgaggattaatgagaaaatgcatgccaagaacttagcacacaactggcattctttctttcacttattcgagacatacttatgagcacctactatgtgccaggcacggggctggcaccaaagatacaatggtaagcaggacaaaaaaaaaaatatccctgcccttgtgagcttataccccatgggtgggaaggggggaagggggttaatatagataatgcaccagcagatacataattaaaacataatacgttgccaggtagtgataaagaccgtgaagaaaaataaggcagaatggagtgtaaaggatttttcattttctattttagatagggtctaaagataggggcagggacggccttttcggaggtaagatctgaacggagatcaatgaagggaaggagcaagacttgcggacatctgggagaacagaggttcagaacgagggggctgcaagtgcaaaggtcctgggatgagagcaagcttgggatatttaaggagcagtaagaaagccagagcgctgggagcagagggcatgagaggtggagtggggttggaagatggatcagcaaggaaacggggaccagaactcctaataaacatacagtaaacatgagctgtccttaacctttgttgagagctagctacgatctgaatagaaataagtgaacttgacctctgacccccctcacctgtcatctagaagttagctgtcaagagattaaatgaaatgtctttagcataaaacattgatgaggccagatacagttgctcgtgcctgtaatcccagaattttaggaggctgagaggggcggatagcttgagcccaggagtttgagaccagttgagtggcatgactccatctctacaaaaaatacaaaaattagccaggcgtggtgacgtgtgcttgtagtcccagccacttgggagactgatgtgagaggatcacttgagcccaggaggcagaagttgtagtgagccgggatcatgccactgcacaccagcctgggcaacagaggaagaccctgtctcaaaaataattaattaattaaaataaaaacattgatgaccaatgcctaagacagggtactccctggagagggggatggaagtgctcatctccgccctgcccctcactgaagcctttggaaaattcacttccttttctgggcctcagtttcctttttgtgggggttaaactagaatgagcaccagtttacgatggcaactgtaatattaatagctgacagttactaagtgctaactataagccagcactccagtaagtgcctcaaacatatgaacccatttcctccccacagcagtatgaggttgaacgatgattagacccaatctccagatgagaaaactgaggcacgggactgaccatttcaacatagtcctttgcaccaaatgctaccagcatctcccatttttttttccaaatcaatttcaaagatcccaaccagaaaagcatgtgtaaaggttaaattgccaaaaaaataaaataaaatgtacatgtcctctgagacacacattttgcatgtatgaacttatttattcattgtaaaatcctgtgaagaaaggactgtggacatttccatttttcagctggggaactgggttcagagaggtgaagacactcttcctgcatcacactgctcatcagggcagaggctagagatgaattcatatccaaatgaatccaaagcctggaacctttttgaccaagccaggctctctcctgaacaccagggtttgcatcccaggaacatggggcccacatgatgggacccatctgggaattatggacaattgatgcatcaaaattcagagggagacatggggctaaacttcccagccgctcctgggagaaccagtctggtggggtggttttgccatgtattcatcttttcttgctgctgtaacaaatgaccccaaatggagtggcttaagaaacacaaatgtattcttttagagttttggaggccagaattctgaaatcattttcactaggctaaagtcaaggtgttggccaggctggttcctcctggaagctccaggagagagaatccatgccttgcctgttccagcttctggaggccacctgcattcctcagctcacagccccacatcacattgctttttctccctctgcttccatcatcctattaccttccgatttcaacttctcctgcctgcctctcagaaagccgcctgtggattacatcaggtccacctggatactgcacaataatctccctgtttcaagatcctttacctaatcacacctggaaagtcccttttttccatagaaagtaacattcactggttcaggggattaggacaccgacacctttggtgggtcactattcagccagccacatgcccgagatttcctttacttaacagctcaccaagcttcatggtggcaagaaggccatccatgtacagatgaggaaattgaggagctggggctatcagtcaacctcagcatccccagacaagacacgcttccaggctatgggtccagtatttcttgaagcataaaaagccaactccagaagactttgggtggaacaatgaggttacctcccttctaatccttctttccttctcattatttccaaaacaaagtctcagtttggtactagtttgtctttaatgcctcacttgatgatatccctccccttgcaacaaagagagggcagatcgcaggcccatagcttcaaccaggcagtatgtacccagtattaatcagcgttaaatatttacctatcaattgctagttttcttctcctaatcatcagtgatgatcctggttttccatacatgatacccacagaaaatctccttttaaagtcattgcatttaagtttttttaaaaggagagggcagtaagacattaatgtaaaaagaataacaggaatgtaattaagtaaataatattgagtggtaagggactctggcaaaaatgatgtgagtggtatttggatgatggaaaccaaaccagattcactccattctggggtgcatgggggaaaactccctgtctgagctccctgaggctcaaatgagatgatagaaggtaaaatcagcaggcagtgtctggccagagaaggtgctcaatccgcagagctggacttgcagtttttttctggaaaacctctgttggggaaaactcaagggcctctctcacttcctggccgctctcacttccaaaatccaggactaagagagaaggaggaggagtgaccgaagtagtgtttagtagctgtgtgaccttggaatttaacctctctgtgcctcactttcctcatctctaaaaatggggataatttttgtttgaacttcctacatctgatgtgaagagtaaatgagctgaaatttgagatgcatgtaaaacagcattttgtaaatgtgagaaaatctgtggctattgctctaattataaactcccactatatgctgagcaccactctggacacctcctgtatcttcccctaattctcgtaacagaatgagagggtgtgagtcctcctcacttcacaaatgagactcagcctcagaaattcaaggtttccagcccaggctcccctcttcagagccagacacaaatccaggttttctcaactctaaagcccatgttctctccaacatttaacttctctgagcctcagtttcatcatctgcaaaataggagaactaaaacatattttcagcattaaataaaaaactaagaatttatagtacaggcacaatgtattaactcactgtggccagaaaataactgggaaagaatataatattatggctgtgttataaatgaagaaaccaaggccagaaatagaaaatgacttgcccagcaagtatgtggaatgcgaatgcagttctgattccaaagcctcaaaactgggaatgaaaggaccatcttcctggtcatctacctgcccacaaattaggcaaatgcaagaaagggggcctctgaccttacaggtgtactaccatcccccccaaatatctctatcccagagtaagtctgctgttggccaccgtgacacctttgtgcaaattagaataaaaggcccttcctcaggtggatccagctgtgcaccagggtgcacagcttggcatgtggaatgcaggctggttcagccttacttgcctcctcaagcaccttgtgcagtgcacagcttgcacaacactctgtagcagccttgccgagagcatccccaaactcttccttctcagagcatctttagagtcacctgtgagtccccagtgttaagaactcctcttggacaggtggtcagtatcatttaatttgctctcagggggcataaggcaggaaagggggtaaggcttctctgcaaacaagtggggctggagcttatttgtaagcctgttttattaataagagtcccatctgtgcccactagctaagatcactccccaaacctctaactcgcaggatggccattcttggaaaacgttgatgtagtccctggggtagcatcccaacttcctgagcccccagcactcttcatagcaagagctaggatccccagtggtgctggaagcggcagccatgcattccagagctcatcccactccttttcatccctgctgacagcatttctgagccagaggacataatgtaagaattgttccttccagctctgctctgcagattgactccagcctccccgaagacaagctcaccagtcaccaggaacaggtgcatgaaaaccaaccctcttaacacacagactcctagaacagcaaagcagcagtggacagatgtcatcaagctggaaacccaggccccaaagaggggttgtctcctactccacactgcctggtaaatgacaaataactgaacatctccaacttctttcctgatgtgatatctgcagtttcgcaagttgttagtgatccatgtatacaatacaacctgcattcatggcgccagaatatccatgtggaagaggctgagaagtgacaatctgatgttggagtggacgctgaggacgcctgtcttgaattgcccagcaagcatgttttgaagttagtccaccagcctctgtttggggaggctctcacagggagtgactggtgaagatgaccagaattgtcttgaagctccatgtgcataacaaacctactgtgcttgctttaacccatgtcccgttttgcaccgagaatactgcactggcagtgagctgcactttttttttttctaaatgggaaatggattaaatgtgtgtcccagatcaataaagatgatgatgttttctaaggatacttcttattcgcattgtatatgaaattgagaaacacgtctgttcttaatgtcagagaatctaataatgacaatcatataaatattgttatatgggagaggaggcttcaggtatgccaacagagattttgagggaggcgaaggtcctccaaagagccaggcctgcctcctgggaggaggccctggttcatcaaccacttaaagaggcagtgacatctagagccatataaagggtccccacaagggaactgtagggaacaaaggggtggtttgtattgaattataactaagaagagcatgtaaggcacagcagttagaaagaagtacagactcttgcctgtaatcccagcactttgcgtagccgaggctggtggatcgcttgagtctaggagtttgagaccagcctgggtgacatagtgaaaccccgtctctactaaaaatataaaaattagccgggtgtggtgacaggagctgatagtcccagctacttgggaggctgaggcaggaggatggcttaagcctgggaggtggaggttgcagtgagccaagatcgtgccactgcactccagcctgtgttacagagcaagaccctatctctctctctctctcacacacacacacacacacacacacatacacacacacacacacacacacacataaaggagtacagactctgcattctggctttgcagcagctgtgtaaccttaggcaagtcacctaaccccgctgagtttccgtttcttcacctgtcaaatagggatgcaaataacagctgcctctctggttgttgtgggcattacatgggacaagcctgacaagctcctagcatggcccctagcacatggtaagagctaagcactcaataaaacaccttcttcatcaggcttagcaccatcataagggattagttacatcccaggggctctccctgttatctctccctgctttccattcagttgtgcatgttggagttcagataggaagaggatcctttgtgaagctcaagcttcagacctctcccaagcctcgtaccgaatcctgtatttgtaaatctgtattcattttcttcaagagtccccctcaagtagtaaatgctccccgccccttaacccttggatctgctcctgggttcatgttcttgctagagaacagagcagagagaagctgtcgggacccctactgagagaatagagaccttgtgttttatctcttcttgccagagagctctgcctatggcctcgcagacagcaatcagtcaaggctcagccacccacacttccaccaaagatgtttcacaaagccttactcaacctctcacatcaatcccagaagctagcggtgtaatcgctccacttacagggaagcaaaacccaaagaggaaaggagattggtccaagatcttaagatccacaggtcagaaagtggcctggggtgggctgagttttgcaaaggtgacctcatccttcttccatcatttattgtgtttttctcttccacgtcgagaaagtctaatagcttagataattccacactaatgaacttgctgtgtgttagccctgggtctccttggaaccactggtgtcaccttcttactccatgtgcccaaggagggctccttcttccaggagaagctccctggtctcagctgatcggtgctgggtaatgcaccactaaattatacctcctctttacttttatttttgtgaacatttaatacctcactgagagatggtgaagcaacttcctggaggtagaagccttatcttacaagcccagtgccctctcatgatgccctggctgggctgggcagggcacaggtgaagaacccaaaagggacctgtggtaccatctccttccagcccccactagtgttgatttcagttatgactcctgaactccacctgcggcctttgatcttacaggggttacttccttggggagactgaaaacagctagggttctggattctgacaagccggggactgaataccgacatagtcacttgctgtgtgactctgagcaagtcactttctctccccgagccttggttttctcctctggaaaatgggtcaaataatctttcccctctgagacgcgttgaaatgattaaataaagtgatacacaaaaggcaaatcctcacccgtagtaagcactcatgaatcttaccgtcctcatcacgtaaggacctggtgcagaaaaagaccagtcactgcttattgggcatttattctgtacaaggtttagttataagagatttacatatattgcctcattgatattcaccgctgccctatgggtgggcactatcatttctcccatttttacacatgagtaaactgaagttcagagaggttaagtgacttgcaccatgtcacacagcttggcacccagtaagtgttcattgtgactgtcgcgtgaaatgtgcaatacagcaccaagcacagaattagagctcaggaaagaaagaattctgctaggcacagtggttcacgtctgtaatcccagtatatgggagaccaaggtgggagaattgcttgagtccaggagttccagaccagcctggacaacatagtgagaccctatctctattaaaaaaaaattagctgggcatgcacctgtagttctagccactagggaggctgcggaaggaggatcgcttaagtccaggagttggaggctgcagtgagctatgatcacatcactgcactccagcctgggtgaccggcgagaacctgtcactgaaacgaaacgaaattattcccatggaagtgagatccagaaggcagggtgggactcaagctctaaggagcagctgggaagagggaagaggcgttaggagcgttcacagcggtccgcggcaggtgcaagggagggaaggcgagggggtctggtggagcctgtctacactgggacctcagcggtctcccaacttggaggcttgggagaagaggatcccgcctgtggttgaccgggggcgcacaggcggaggaggcgttaccttgggcgggagggcgaagaccaccggcagcagcgcgagcggcgtgaacagcagcaccagcagccgccgcgcgctccacaccttcttggccgctgctgccagcgccgccatcagcgcgatcgcctggcggtacgggccggcccgggactgccccgcctggccccggcgccggcttaaagcctgggggagggtcggggaggggactgcgctggggaacccgccctctccctgctcctcctggaggaaaagggtggtgcctgcgcccctgggaccgggtgaaagaggcccgggaacgttggagaaagttaggcactagaattagcaaacgggaccccagccgcagggcagtgtggccttgcctcttggcttcccagcaatgtggcctggggcagctggcttatcctctcctcgcctctgtttactcgcctgtgagatggctgaggatgacaaggcgaggattaaggcgcgtactcctattacccgggttcaaatcctggcacggccacttactcactgcgtggccttcaacaacagcctctgagcctgaaagtggagtggtgataataatagtctacaccatggaatactatgcagtcacaaaaaagaaggacatcatgttttttgcgggaacatggatggagctggaggccattatccttagcaaactaacacaggaacagaaaaccaaatgccgcatgttttcacttataagcgggagctaaatgatgagaacacatggacacatagaggggaacaactgacactgaagcctatgggaggctggagggtgggaggagacagaggatcaggaaaaataactaatgggcactaggcttaatacctggatgacgaaataatctgtgcaacaaatccccatgacacaagtttacctatacaacaaatctgcacatgtacccctgaacttaaaagttaaatttttaaaaatagtctacaccagacaagaaggttgttaggaagtttaaatgagataacacatgtaatgtgattagcgcagtgtctggcagagcaggtgctcaatgagagttattgctgctgatgagttattcttatttttgggtttttttttcttttttttgagatgtagtctcactctgtaacccaggctgggctggggagcagtggagcgatctcggatcactgcaacctctgcctcccgggttcaagcaattcttctgagtagctgggattacaggcgtgtgccaccatatctggctaattttttttttttttttttttgtatttttagtagagatggggtttcaccattttggccaggctggtctcgaactcctggcctcatgatccgcccatctcgggcctcccaaagttctgggattacaggtgtgcgtcaccacgcccggccgttattcttatttttttttaaggggggtgagtcacttctattcacttctgattattctcaggtaaccatacaggagtgcaactgttgggttgcccagtatttgcaatgcttagctttttaagacactgtcaacctgtcttccaaagtgattgtactattttgcacttccatcaacaatgtatgaatcatccagtttctccacatctttgccaacatttggtgttgtcactgtttattttattttaaccattctgacagggacatagtaatagctcattgtggttttaatttctatttccctaatggctagtgatgtttaacatcttttcacatgctaatttgccatctctatatcctctttggtgaactatcttttcctgtcatttgcctgttttctacttgtattatttggttttttacagttgagttttgaaagttctttgcaaattctagatgtcagttctttgccagttacgctgtttgcaaatatttctccccgtctgtagcttgtcttttcagcctcttaactatatatcaccaagcaaacatttctaattttgatgtagttaaatttatcaaatttttcctttggatgatcgggttaagctctctgcatagccttagaccccaaagagtttctcgtatgtttagtttgctttgttctcacagaagtgtccaaggaagagaatacagtcatgggttcttagtttctgtttctggttgggccagtaaagccccttcctcatccctcttttccactcatcactagagacagaaactaaaaaccatggcttcaggctgctaaaagcttaaaacaaacaaacaaacaaaaaaagaacaacaacaaaataaggcaggttggacaagcttgtcagaagttttacagttttgaaacactgtattcattacaaaataacttcattctctcctcccacagcctctggaaaccatcattctgctttctgtctctataaatttgattaatctggatagctcatacaagcggtatcatggaatatttatccttttgtgattagctttgtgtccttaaggctcacccatgttgtagcatgtgtcataattcctttttaaggctgaataatattccattgtatggatatactatatcgtgtttatccattcatttgttgatagacattgggttgtttctaccgtttggctattgtgagtaatgcagctataaacataggtgtacaaagagtatctgtctgagtccctgctttcagttctgggtatatacccagaagtggaactgctggatcataaggtaattctgcgctttttgaaaattattattgagaaatggccatactgtttttcacagaggctgcactattttacattcccacgatgtgcaagggttccagtttcaccacatcctcaccaacacttattttctgtgatttttttaaataatagccatcctaataggtgtgaagtggtatcccactgtgattctgatgtgcgtttctctaatgattattgatgttgaacatctttccatgtgtttattggccatctgcgtatcttgtttggagaaatgtctatccagggccttggtccatttttttagcattttggtttttgtcacttgcatggcttttttcagtaattgctctaggtattacattgcatgtacataacttataagttataatccactggtattgccatttaaccaattccagcaaagcatagaaaccttacttcatgcccctttgccttacccagtttaaaatacttctttcaatattttctctacatacatttagaaccacatcagtgttttaacttttccttcagctatcaggtataatttttttttcttgttgacatggagttttgctcttgttgcccagactagagtgcaatggcgccatctcagctcactgcaacctccgccttccaggttcaagtgattctcctgcctcagcctcctgagtagctgggattacaggcacccaccatcacacccggctaattttttgtatttttagtagagacgggtttacaccatgttggccaggctggtctcaaactcttgacctcaggtgatccaccggcctaggcaacacaaattgttgggattataggcatgagccaccatgcctggccaagaacttcctttaatcattctttgagaccaggtctgcaggcaacaaattctcttagttttccaacatctgagaaggtcttgatttccccttggttcttatttttggtggacatagaattctgttattttctttgagcacttgagaaatgctatgcacctactttctggcctccatggtctctggtgaaaaatctgatatcatttgagttatttcttctccataggtaaggttcatttctctttctcttgaataaatattttccaagatttcttttttttgtcttatgttttgagaagtttggccatgatatgtcttggtgtggatttccttggtttaccctagcaatatttggagttcactcagcttcttgggtctgtagatttataatatacacatacatatatacacatatatatacacacgtatatacacatatgtatacacatatatacacatatatacacatatatacacacacatatatacacatagatatgttcattcatatatatatataccaaatatacatatatgtatatataagccaaaagaggtttaattagctcatggttatgcaggctttacaggaagcatggtgctggcatctgctcggcttctggggaggcctcagagagccaacatgtatatatatgtgtgtgtgtgtggtatatatataatatatatttttatatagtatatattatatatactatacaaaaatacagatatactacacaataatattccattgtatggatataccatatcatgtttatccattcatttgttgatagacattgggttgtttctacctttcggctattgtgagtaatgcagctataaacatgggtgtacaaagagtatctgtctgagtccctgcttttatacaaaagaaaataatatatatatactatatatatattttatacaaaagaaaatagtatatatatgccttcagtatatataatatataatactgtatatactatatatactatacagtatatattatactgtatataatatatatactgtacagtatatattatactgtatataatatatatactgtacagtatattatatatacgtatataatatactacagtatatatatacagtatacatatatgtatatatgtatgtatatatgtatatatgtatactacatatactatatatacagtatatatacatatactacagtatactatatatacatatactacagtatactatatatacatatatattatatatactgtacagtctatattatactgtatataatataccacacagtctatattatactgtatgtaatagactgtacagtctgtattatattgtatataatatagactgcacagtatatataatactgtatgtgatgtagactgtacagtatatattatactgtatacttatatagactgtacagtatatattatactgtatataatatactatacagtatatattatactgtatatgatatactatacagtatatattatactgtatatgatatactatacagtatatattatactgtatatgatatactatacagtatatattatactgtatatgatatactatacagtatatattatactgtatatgatatactatacagtatatattatactgtatatgatatactatacagtatatattatactgtatatgatatatactatacagtacatatattatactgtatatgatatatactatacagtacatatattatactgtatatgatatatactatagtgtatatattatactgtatatgatatatactacctattattatatatatagccaaatttgggaagttttcagccattatttctttgaataattttatgtcccactttctttctcctctccttgcataatttcagtgatacagatgttagctcttttgctgtagttccccctgtccctgcagctctatttaccttttcagtctattctctctctgttgttcacagtgggtaatttccattgttccatgtcccggttcactgatccttctgccttctccatttgctgttgaacccatccgttgtataatattcttcagttatacaattttcatttgattcttctttgtaccttctattactttgctaagtcttctgtttctttgctgaggttttctacttttttcgtttgtttccagtgtgacacatcactgtcatcttaatattaagcatcaaaagtcagtttgaccagcctggtcaacatggcaaaacctcatctctactaacaaaccaacaaaaaaagcttttgagaaaaagtttgaaaaaaaacttttatcatgatccgggacatcatcagagagcactgagcttgtaagatagggcttctacctccaggaagtagctgggtgtgatggcatgcttgtaatcccagctactcaggaggctgaggcacgaaaatcatttgaacccgggaggcagaagttacagtgagccgagatcgcaccactgcattccagcctggatgacagagtgcgaaaatgtctcaaaaaaaaaaaaaagtcagtgtgagaccttccacttgtcttatacaacaagtgactttcgtttggaacctggacattttgggtactgtattacgagattttggctcttatttaaaacttgtttttgctgacttctttcagtgctcttgcaaaggaaatggggatgtcacctcattactacaagacgaaagtagaagtccagttccccacctcatcctccattaatatctgaggtggggggagttgttaggccgtttctgcattgctataaagaaatatgtgaggctgagtaatttataaagaaaagaggtttaatgagctcatcgttctgcaaggttgtacatgaaacatggcgctgtcatctgctcagcttctggggaggccttggggagcttttactcgtggcagaaggcgaaccaggagcaggcaggtcacatgtccagagcaggagcaaggcgctggggggaggtgccacacacttttaaacaaccagatttcctgagaactcatatctcaaggacagcacggatccaaccccatgacccaaacacttcccaccaggccccacctccaacattagggattgtatttcaatatgagatttggacaggacaaacatcaaaaccatctcaggggggttcattactgctggggagtgctgggagttctagctcccatcagccctctcctgatacctccctggctagaggagtaggagtgccttgtctttgctccccatgtggcttccattgacactgcgggagggtggtgtccttgttgctgctgggtggtagttactttggaatactgatacatgcaacactctaaataaatatcaaaaaaaaacccattatgctatatgaaagaagctgaacataaaaaaaactacattctgcataattatatctatatgaagagttaaaagaggcaaacttcaattatagaaaccatatagtgattgccaagcaatgggggtcaaaagacaggatcaactggaaacagcatgaggaaatgtatagggtgatagatgtgttctgctgactgtggtggtggtaatacagttgtatataattattaaattccatcaaactgatcatttaaaataggtgaattttattatatatagttatacctcaataaagccagaacagaagtgcattgaggtcaggtgtggtggctcacacctgtaatcccagcactttgggaggccaaggcaggaggactgcttgagcccaggagttcgagaccagcctgggcaacacggtgagatcctgtctctaattttttaaataaattgttttttaaaagtgattgagtatatttagcgataaaaaatattcattggatcaagttggctgatcgtgttcttcaaatttagattcttaaagtctccaattcaattatggatttgtctatttctcactttagttctgtcaattttcacttcatagattttgaagctctgttattaaatgtgaacacacttaagattgttatgtctttattggtggattcacctttctatcattctaaaatctctctctttatcaccatagatgccctttgtgttgaagtccactttatctgatatttaaatagccacaatagttttcttatgctcaaagtttgtattgtatatcttttccactttttttaaactgtcaacctgtttctatatgtacaatgtgtttattctatacagtgtattgatgaactctgcttttttatctagtctaacattctctgatattttaattggaatgtctaatcaatttacatctaatataattatttatctggttggatttaagtgtcttattttgctattagttttctatttatcttatttgttctttgttcctctcttcctcctctcttgctttcttttgtatcaactgattatattttggtgcattttatttcctctattaattttttagcttttttctgttttattattttagtggtttctctagagattatgatatgcatctttatcacagtctacctttgcacaatgatatattattttaggaacaatataagagccttacaataatggtggccaagtatggttgctcatgcttgtaatcccagcaatctgggaggctgaggagggtgttgcttgagttcaggagtttgagaccagcctggccaacatggtgaaacctcatctctacaaaaaatacaaaaattagctgagcgtagttgcaggcatctgtagtcccagctaccggggaggctgaggtgggaggatagctcgagcccggggaggtggaggttgcagtgagctgagatcacagtactgcactccagcctgggtgacagagtgagaccctatcccccccccccaaaaaaaaaaagaaaaaacaaagaaagaaagccttacaataatggaaataatgtaaaaaaattccatttaccaccctcttctcttcctttgtacttttattgtctttttaaatttgtgtattctataaacccaagtatgtgctgaagataactcatgctagcttatgagaaatgactgttactctttcagaaaatttgtgagccagctgtagaactgatggtagcatgaaatcacccatagcaagaatatttacaccatgaaattaataaaattctataaataagggcttttcttccagcagccaattgttaaacatttaccagaacaccactgtttgaattacacaacatattgttttaattttataaacaatcaatagtctttaaaagacatgtataaattatataaataaaagataaatgtactttaaaaagtatttcatattttcccaaatatttaccctatctcttcacttcttcctgcagatccaggatcatttctctttcaggtgctagcatttcttttaccatttcttatagtgctggcttgttgaaaggaaattctctcagcttctgtttatctgaaagtatctttatttttgcttttgtttttgaagttactttcaccagatatagaagtctagattgacaattttttttcctttagtacttaaagatctcattccattgtgttcaagtttctattgtttctggtaagagattagccaccattcatatcattgatcccctgtaagtaatgtctggtaagaaattagccaccattcatatcattgttcccctgtaagtaatgccccatttttattctggctacttgtaagatctctttatctttcacttttcagcagtttgactgaaacgtttaggtgtagtgtttcccttatatttatttactcggagtttgctgagctgcttggatctgtgcattgatgtctttcatcaattttggtatatttcccgtcattatctcttcaaatacctcttttgccccattctctctctcctttccttctagaattccagtaacatttatgttagagcatttggtatcatcttacaaatttcagactctttgttctttatttttttcacttttccttctctacgtgtttcaaacaggcattttctattacctgtctttagtgattcctgtctttgttgtgcccagtctcttatagatctaagtcttcatttctgatgtagtatttttcatctctataattttcactagttcttttaatagtttccaggtctctgctgaagttttccatttgtttatgcatgttgttctttagattctttcatttttagaattttgttgtagattttttaagtctctgggaattccagaatctaggccaaatctgaatctgcttctattaatacttttctttaatgactgtcacattttattattgtctgtgtggttgctaatctttgaacgcattgttgacatttttgtaagaaagaacagtagagaatgaagtaaataatatttacctccagaagggggtactccccttttcctgtaaaaccgatagagtatggaattaaccagtcttacctgcagtatggagttaatcggttttacccgtagtatggagttaaccagtcttacctgtggttgaactggatttcagctttggtgcagttttagattgtttcagttcatcactggctccaaatgttttgagggtagatttagaacttttccttcagcagatctgagaccggagcactggtgagattttaggaatctgcctttgcttcccagaagagttacccagtttgggaatgttgggagttctctctcttgtgtagagccaagttgccatggggctttttggtcattggtgagttctctttgttctcaaatcctgccccccatttcctgcacctgggaggattttttcagcctagttgttgttcatctggcctttggagggctatggttctacacattttgaaggtctggaatgactggtaggggtgtcttttcactataagcttctgatagtcaaaagccaggcatgcctgggaggggagggaatctctcaattcttctacctcaggttttctgtctgttctcctgacctgttcccctgtgcctacttttgagagtgtcttatacttaagagaggccccttgctttcaggggaatccttcttatccctccttttatcacctgttttggtgtaatatcccgcacttgataaatcccatggtaagacttggtgggcagattcagacctattcagtgagtagagtttatctccattataagctacacagaagctctcatgttattgaaaatttagctggtttcttcctgcccatccatggcagtctcctctttctccagcagttgtgttaggatttggagcagctatgagtctcttctcccccattatgatcttggcatttcctcctggaggttagctcctttaggtttctttgtgtcctcagctttccatgaagtttttaaaactatgattttatagctaataaagcctattttgatggggtggtgttagagtgggagcaacagtctcttatcatttcctatactagaaccagaagtggaactctttccaaaaaaataataacaaaaacatgtttctaataatgccatcagacattgttgtagtctatcaaaataccaggaccattgggtcattcctgcctaccatgtgaaagtcaaagaatatttcatttgggggaaaaactcaagtctttcaagattaaactccaagtagaatacagagacttatgggtacccgatatagcagacgaaaacgatattacaaaaaggaagtaagcacctgctatagcagggaaaggttatattacaaaaaggaactaagcacactgctcaaacactctggatcattcaagatgaacctgaatcatcttgaaatatacaacaagatccaaaatgttctgatgagaagtcagccagttggtaactcagctcctataggcatggcatgtttgagacagcactcttttgcttttgaattgggtgagattaccaaatgctcatgaagaattttttctttgttgttgtatctaggaaggggtaaaaattagaaccttgcaaagttctgaaaatataaataagaaacaaagtaaattatatgagttcagcacttttgtaactgaccttggtgtgaagatatgaatttataagtcttatcagcaatgaatttgtgtatatttggtctgctgtttaatatgcttgaaccatttgaaataatctgcttgggggctgggcatggtgtgtcacacctgtaatcccagcactttgggaggccgaggtaggattgcttgagaccagaagtttgatatcagcctgggcaacatagtgagatatcatcgctgttttaaaataaataaaataaaataaaaaagaatcaccctagctgggtgcagtggctcacacctgtaatttcagcactctgggagactgaggcaggaggaccgtttgagctcaggagtttgagatcagcctgggcaacatagtgagaccctgtctctacaaaaaaattacaaaattagcaggccatggtggtgcacgcctgtagtctcagctactcgagaggctgaagtgggaggattgattaagcccaggaggcgaagggtacaatgagctataattgtgccactacactccagcctgggtgacagatcgagaccctgtttcaaaaaaaaaaaaaaagttggggggctttaccaagatttgtaattgcagtttatattgttcaagggaatttaatcaagtttgtgatctatgtcaaatgcaaggaatgttggctttccagcttatttattcgtgaataataatggccacactcactacgtgtttactccagttcaggtcctattctaagagctttacatgatttaattcattgaacatttaaataaccctatgaaataggttctattatattcccattttgcagaggaggaaactgaggtacagggaaattgagtaacttatccaaggacacacagctactgagtggggattcaaacccaagcaatttcactgcagagtccacatgcgtaaccaaccactacactgtaataactctagtataggtgtttattagatctgggcaatatgactttaatactgagcattgaacaaagtagcagtgagtatccttcatgcaccaaatccctgaaagtagtaatattaaaggagttgtcgacaatgtgagtgtattcactcaagaggctgtttcccaacactcattcccctcagataacaagggtgctacatgcacttctttaaacttctagcatgtggttctcaaccccggctgcacattggaatcacctgaggagcattaaaagtgctgatgctccatcctcagagtctgatttcattgtctagggtgtggcttgggcatcaggattttttttaagctccaagcagattctaaagggtagcttggattgagaaccactgtccctaaaaatctaattcatcctttgccagattctggtgaaacctgggaaatgtgaactggctttttatcacatcacgtctaaaggctgaagcgaccctcctgagttagtacagaatcttgacacccaacagctttggggcctgggcattggtctatgttagatgccttgtcaatgtttacttaactattaataatatttgaatacctaccagacttggttttgctcattagcaaacttgggattaatcagacatacctttcaccatgtgttttactcaatatttgctatatggcaaccatataccaggctgtatatacactaatgaataagactaaaaaattaaaatccctgacctcatggaacttaaatgatggcaggtgcaaataataaataaatgagtaaaatgtattataatcaaaagatgaaaatatgacaaatctgggaagaaaacacaaggaagcagcaaagggaagttgagagtggtgctttggaggtgctgttgtagataaggtggtcagggaagctgtccatgaagaggaccctaagttaaaccaagacctaaagaaagtgaacacatgaacttctgggtatacaaaggaagcattccaggaagaaagagaagtcaaacgcaatggctttgaggcagcaggcaacatgacaggtcttagcatcatcaaggaactggagtgcagagacaaggtcacagccagccagcaaggactcaaagtaggatcctgaaagcccaagtagggattttcacactcagtgacaagggcagccattgtagagatttaagcagagtggcatattctgctttcattttttttttaagtcagtgttactgagatatagttcatatagcatataattcacctgtttaaaagtgaatatgtcaattagccaagcatggtggtgtgtgcctgtagtcccagctacttggtaggctaagacaggaggatcacttgagcccaggatgtcaaggcttcagagagtggtgtttgcatcactgcactccagcctgggcaatagaatgagacactgtctcaaaaaaaaaaaaaagtatgtgtaatgtaatgatttttcaggacactcacaatgcaaccatcactacaatcaatttaacacattttcatcaccccaaagggaaatctcatgcccactaacagtcactccctatctccccacaacctccccagtcccaggcaactactaagatactttctgtctgtatagatttgcctactctggacatttcatataaatggaatcatataatatgtggtccttttgtgtctggcttctctgacttaacataatgctttcaagattcatctctgtcacagcacgcattggtactacatttctttttattgctgaataatatttcattgtatgggtgtatcctactttattattcaatcatcagttaatacacatttggaccgtttgaactttctggctattatgaataatgctgccttgacctttagtgtacaagtttttggacatgtttatatttctcttaggtacatacctaggagtggaatttctgggtcatatggtaactctatgtctaaccttttgaggaactgcccaactgttttccaaggtgtctgcactatttcacaatcccaccagcagtgtatgcgggttccagtttctctacatcttcccagcacttgctattatttaccttttttatgatagccatcctactgcgtgtgctttttatttcaaagataactcaggctaagacaatggtggcttggaccagagtagtaacagcagaggtggtaggaaaggattcaattctggatatactttgccagcagagctggtaggtcttgctgaaactctgatgaggctatgagagagaggaactggtactgggatcaaatgtgagatggtggaatatttctcaaagtgtgagaggaatactagtgaggaaacacagataattttatgtcaggcatttaaataacattgagtcacagaaagtgaaagttatcctgtgtcacttttcttcaactcctcattataccgtggagagagtctcagttgggtgtcagtatccctttaagacctcatcacctataaatcttcctttgtaacagacagaaaagggtttggagtcagaaacattgggctcttgctgagccaggcaatattgttttatttttattttatttattcttataactacttttgactgaaagagagtgattttttgttttggttttggttttgttgctttgttgttgttgttgttgttgttgttgttgttgttgttgttgttgctttgagacagggtctcactctgttacccaggctggagtgcagtcgtgtgatcacggctcactgcagccttgacttccctggcttaagcaatcctcccacttcagcatcctgagtagctgtaactacaggcgcacaccaccatgcctggctaatttttaaattttttgtagagatagagtcttgctatgttgcccaggctggtctcgaactcctgggctcaagcgaccctcctgcctcggcctctcaaagcgttgggattacaggcatgagccatcacacctggctgtgattttcatttttttattaaagcctatgacttttttagaaagctctctgtttaacttatatctatttaagtttacaatgtaaagcaactcaaagaaaaatgccaagtaacttggagtgcagggagtacgtgacaatggcaaaattccaaaaatttgaggccaaaatctgaaatttgggagactacgagatagcaagagaaagacccaggaaggggtgtggcactcacttcctatccagatcatgctgatgctgttcctataaacaccgagggcaagttatttcccaacggacccattccaagctatgatgaaactgtctcccatgacctttcaggttgggacttgatcctgagccagcccaataaccggcttcatcaaaggctccagacaacagtgtatggagggacaaaggccctccagggagcactttggaccttcaaggtctgggcatgggaggatggggtactccaaactggaaaaggtatttctagagaattggattcattgacatcaaaggaactctggtccatgccccaaagtctgagtggaggcagctgggaccagggcatattttaccggtgggcctgggttggattccctgttccagaaccagctaagagattaagagtacaatatttagcattagagcagaggtttcaatctggtggcccaaatgtagccatcatcataacaatattaatattagcaagcccatataccacaccttactatttgccaggctccgttttcagtactttacctgtcttaactcattccatccttataaaatccatgcattacttgtgtgagtctatcacccatgcattagacaaagctacattcaaattctggctgggccacttgctcgttgctgggcaggaggtttcactcaaactgagtttcctcatctgaaacgagaactataatgtgtacaggcatatcttgtct
